US010900055B2

(12) United States Patent
Huisman et al.

(10) Patent No.: US 10,900,055 B2
(45) Date of Patent: Jan. 26, 2021

(54) ENGINEERED TYROSINE AMMONIA LYASE

(71) Applicant: Codexis, Inc., Redwood City, CA (US)

(72) Inventors: Gjalt W. Huisman, Redwood City, CA (US); Joyce Liu, Fremont, CA (US); Nikki Dellas, Mountain View, CA (US); Chinping Chng, Menlo Park, CA (US); William Casey Hallows, San Francisco, CA (US)

(73) Assignee: Codexis, Inc., Redwood City, CA (US)

( * ) Notice: Subject to any disclaimer, the term of this patent is extended or adjusted under 35 U.S.C. 154(b) by 0 days.

(21) Appl. No.: 16/436,176

(22) Filed: Jun. 10, 2019

(65) Prior Publication Data
US 2019/0376097 A1 Dec. 12, 2019

Related U.S. Application Data

(60) Provisional application No. 62/683,706, filed on Jun. 12, 2018.

(51) Int. Cl.
*C12N 9/88* (2006.01)
*C12P 7/42* (2006.01)
*C12P 13/22* (2006.01)
*C12N 15/63* (2006.01)
*A61K 9/00* (2006.01)
*A61K 31/122* (2006.01)

(52) U.S. Cl.
CPC ............. *C12P 7/42* (2013.01); *A61K 9/0019* (2013.01); *A61K 9/0053* (2013.01); *A61K 31/122* (2013.01); *C12N 15/63* (2013.01); *C12P 13/225* (2013.01); *C12Y 403/01023* (2013.01); *C12Y 403/01024* (2013.01)

(58) Field of Classification Search
None
See application file for complete search history.

(56) References Cited

U.S. PATENT DOCUMENTS

| 5,605,793 | A | 2/1997 | Stemmer |
| 5,811,238 | A | 9/1998 | Stemmer et al. |
| 5,830,721 | A | 11/1998 | Stemmer et al. |
| 5,834,252 | A | 11/1998 | Stemmer et al. |
| 5,837,458 | A | 11/1998 | Minshull et al. |
| 5,928,905 | A | 7/1999 | Stemmer et al. |
| 6,096,548 | A | 8/2000 | Stemmer |
| 6,117,679 | A | 9/2000 | Stemmer |
| 6,132,970 | A | 10/2000 | Stemmer |
| 6,165,793 | A | 12/2000 | Stemmer |
| 6,180,406 | B1 | 1/2001 | Stemmer |
| 6,251,674 | B1 | 6/2001 | Tobin et al. |
| 6,265,201 | B1 | 7/2001 | Wackett et al. |
| 6,277,638 | B1 | 8/2001 | Stemmer |
| 6,287,861 | B1 | 9/2001 | Stemmer et al. |
| 6,287,862 | B1 | 9/2001 | delCardayre et al. |
| 6,291,242 | B1 | 9/2001 | Stemmer |
| 6,297,053 | B1 | 10/2001 | Stemmer |
| 6,303,344 | B1 | 10/2001 | Patten et al. |
| 6,309,883 | B1 | 10/2001 | Minshull et al. |
| 6,319,713 | B1 | 11/2001 | Patten et al. |
| 6,319,714 | B1 | 11/2001 | Crameri et al. |
| 6,323,030 | B1 | 11/2001 | Stemmer |
| 6,326,204 | B1 | 12/2001 | delCardayre et al. |
| 6,335,160 | B1 | 1/2002 | Patten et al. |
| 6,335,198 | B1 | 1/2002 | delCardayre et al. |
| 6,337,186 | B1 | 1/2002 | Krebber |
| 6,344,356 | B1 | 2/2002 | Stemmer |
| 6,352,859 | B1 | 3/2002 | delCardayre et al. |
| 6,355,484 | B1 | 3/2002 | Patten et al. |
| 6,358,740 | B1 | 3/2002 | Patten et al. |
| 6,358,742 | B1 | 3/2002 | Stemmer |
| 6,365,377 | B1 | 4/2002 | Patten et al. |
| 6,365,408 | B1 | 4/2002 | Stemmer |
| 6,368,861 | B1 | 4/2002 | Crameri et al. |
| 6,372,497 | B1 | 4/2002 | Stemmer |
| 6,376,246 | B1 | 4/2002 | Crameri et al. |
| 6,379,964 | B1 | 4/2002 | delCardayre et al. |
| 6,387,702 | B1 | 5/2002 | Stemmer |
| 6,391,552 | B2 | 5/2002 | Stemmer |
| 6,391,640 | B1 | 5/2002 | Minshull et al. |
| 6,395,547 | B1 | 5/2002 | Stemmer |
| 6,406,855 | B1 | 6/2002 | Patten et al. |
| 6,406,910 | B1 | 6/2002 | Patten et al. |
| 6,413,745 | B1 | 7/2002 | Patten et al. |

(Continued)

FOREIGN PATENT DOCUMENTS

WO 95/22625 A1 8/1995
WO 2012/059849 A1 8/1995

(Continued)

OTHER PUBLICATIONS

Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Beaucage, S.L., et al., "Deoxynucleoside phosphoamidites—A new class of key intermediates for deoxypolynucleotide synthesis," Tetrahedron Letters, 22(20):1859-62 (1981).

(Continued)

*Primary Examiner* — Hope A Robinson
(74) *Attorney, Agent, or Firm* — Codexis, Inc.

(57) ABSTRACT

The present invention provides engineered tyrosine ammonia-lyase (TAL) polypeptides and compositions thereof. In some embodiments, the engineered TAL polypeptides have been optimized to provide enhanced catalytic activity and enhanced acid stability, while reducing sensitivity to proteolysis and increasing tolerance to acidic pH levels. The invention also provides methods for utilization of the compositions comprising the engineered TAL polypeptides for therapeutic and industrial purposes.

23 Claims, No Drawings
Specification includes a Sequence Listing.

(56) References Cited

U.S. PATENT DOCUMENTS

| | | |
|---|---|---|
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,605,430 B1 | 7/2003 | Affholter et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selfinov et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B2 | 6/2008 | Raillard et al. |
| 7,421,347 B2 | 9/2008 | Selfinov et al. |
| 7,430,477 B2 | 9/2008 | Selfinov et al. |
| 7,462,469 B2 | 12/2008 | Bass et al. |
| 7,531,341 B1 | 5/2009 | Vellard et al. |
| 7,534,564 B2 | 5/2009 | Patten et al. |
| 7,534,595 B2 | 5/2009 | Vellard et al. |
| 7,553,653 B2 | 6/2009 | Kakkis et al. |
| 7,560,263 B2 | 7/2009 | Kakkis et al. |
| 7,620,500 B2 | 11/2009 | Mundorff et al. |
| 7,620,502 B2 | 11/2009 | Selfinov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selfinov et al. |
| 7,868,138 B2 | 1/2011 | Stemmer et al. |
| 7,873,477 B1 | 1/2011 | Gustafsson et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selfinov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selfinov et al. |
| 8,762,066 B2 | 6/2014 | Fox |
| 8,768,871 B2 | 7/2014 | Fox |
| 9,593,326 B2 | 3/2017 | Clark et al. |
| 9,605,252 B2 | 3/2017 | Huisman et al. |
| 9,611,468 B2 | 4/2017 | Huisman et al. |
| 10,144,924 B2 | 12/2018 | Huisman et al. |
| 10,160,963 B2 | 12/2018 | Huisman et al. |
| 10,287,567 B2 | 5/2019 | Huisman et al. |
| 10,294,468 B2 | 5/2019 | Huisman et al. |
| 10,358,639 B2 | 6/2019 | Huisman et al. |
| 10,487,319 B2 | 11/2019 | Huisman et al. |
| 10,494,623 B2 | 11/2019 | Huisman et al. |
| 2008/0220990 A1 | 9/2008 | Fox |
| 2009/0312196 A1 | 12/2009 | Colbeck et al. |
| 2012/0177722 A1 | 7/2012 | Weiner et al. |
| 2013/0039898 A1 | 2/2013 | Okhamafe et al. |
| 2015/0299689 A1 | 10/2015 | Huisman et al. |
| 2018/0230448 A1 | 8/2018 | Chng et al. |
| 2019/0211320 A1 | 7/2019 | Huisman et al. |
| 2019/0241882 A1 | 8/2019 | Huisman et al. |

FOREIGN PATENT DOCUMENTS

| | | |
|---|---|---|
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 00/42651 A1 | 7/2000 |
| WO | 01/75767 A2 | 10/2001 |
| WO | 2008/069958 A2 | 6/2008 |
| WO | 2009/152336 A1 | 12/2009 |
| WO | 2010/144103 A1 | 12/2010 |

OTHER PUBLICATIONS

Black, M.E., et al., "Creation of drug-specific herpes simplex virus type 1 thymidine kinase mutants for gene therapy," Proc Natl Acad Sci USA, 93:3525-3529 (1996).
Botstein, D., et al., "Strategies and applications of in vitro mutagenesis," Science, 229(4719):1193-1201 [1985].
Caldwell, R.C., et al., "Mutagenic PCR," PCR Methods Appl., 3:S136-S140 (1994).
Carter, P., "Site-directed mutagenesis," Biochem. J., 237:1-7 (1986).
Christians, F.C., et al., "Directed evolution of thymidine kinase for AZT phosphorylation using DNA family shuffling," Nat. Biotechnol., 17:259-264 (1999).
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling," Nat. Biotechnol., 14(3):315-319 (1996).
Crameri, A., et al., "Molecular evolution of an arsenate detoxification pathway by DNA shuffling," Nat. Biotechnol., 15(5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80: 21-25 (1983).
Guo, Z., et al., "3'-End-Forming Signals of Yeast mRNA," Mol. Cell. Biol., 15(11):5983-5990 [1995].
Henikoff, S., et al., "Amino acid substitution matrices from protein blocks," Proc. Natl. Acad. Sci. USA, 89:10915-10919 [1992].
Ikeda, K., et al., "Phenylalanine ammonia-lyase modified with polyethylene glycol: potential therapeutic agent for phenylketonuria," Amino Acids, 29(3):283-287 [2005].

(56) References Cited

OTHER PUBLICATIONS

Kramer, B., et al., "Different base/base mismatches are corrected with different efficiencies by the methyl-directed DNA mismatch-repair system of *E. coli*," Cell, 38(3):879-887, 1984.

Ling, M.M., et al., "Approaches to DNA Mutagenesis: An Overview," Anal. Biochem., 254(2):157-78 [1997].

Matthes, H.W.D., et al., "Simultaneous rapid chemical synthesis of over one hundred oligonucleotides on a microscale," EMBO J., 3(4):801-05 (1984).

Minshull, J., et al., "Protein evolution by molecular breeding," Curr. Op. Chem. Biol., 3(3):284-290 (1999).

Needleman, S., et al., "A general method applicable to the search for similarities in the amino acid sequence of two proteins," J. Mol. Biol. 48:443-453 (1970).

Pearson, W.R., "Improved tools for biological sequence comparison," Proc. Nat'l. Acad. Sci. USA, 85:2444-2448 (1988).

Romanos, M.A., et al., "Foreign gene expression in yeast: a review," Yeast 8:423-488 [1992].

Simonen, M., et al., "Protein Secretion in *bacillus* Species," Microbiological Reviews, 57:109-137 (1993).

Smith, M., "In vitro mutagenesis," Ann. Rev. Genet., 19:423-462 (1985).

Smith, T., et al., "Comparison of Biosequences," Adv. Appl. Math, 2:482-489 (1981).

Stemmer, W., "DNA Shuffling by Random Fragmentation and Reassembly: In vitro Recombination for Molecular Evolution," Proc. Natl. Acad. Sci. USA, 91:10747-10751 (1994).

Stemmer, W.P.C., "Rapid evolution of a protein in vitro by DNA shuffling", Nature, 370:389-391 (1994).

Villa-Komaroff, L., et al., "A bacterial clone synthesizing proinsulin," Proc. Natl Acad. Sci. USA, 75:3727-3731 (1978).

Watts, K.T., et al., "Discovery of a Substrate Selectivity Switch in Tyrosine Ammonia-Lyase, a Member of the Aromatic Amino Acid Lyase Family," Chem. Biol., 13:1317-26 [2006].

Wells, J.A., et al., "Cassette mutagenesis: an efficient method for generation of multiple mutations at defined sites," Gene, 34:315-323 (1985).

Zhang, J-H., et al., "Directed evolution of a fucosidase from a galactosidase by DNA shuffling and screening," Proc. Nat. Acad. Sci., U.S.A., 94:4504-4509 (1997).

Zhao, H., et al., "Molecular evolution by staggered extension process (StEP) in vitro recombination," Nat. Biotechnol., 16:258-261 (1998).

NCBI Accession No. YP_001865631.1 dated Jun. 10, 2013.
NCBI Accession No. YP_007056096.1 dated Jun. 11, 2013.
NCBI Accession No. YP_007127054.1 dated Jun. 11, 2013.
NCBI Accession No. ZP_07108482.1 dated Nov. 9, 2010.

ENGINEERED TYROSINE AMMONIA LYASE

The present application claims priority to U.S. Prov. Appln. Ser. No. 62/683,706, filed Jun. 12, 2018, hereby incorporated by reference in its entirety for all purposes.

REFERENCE TO A "SEQUENCE LISTING," A TABLE, OR A COMPUTER PROGRAM LISTING APPENDIX SUBMITTED AS AN ASCII TEXT FILE

The Sequence Listing written in file CX7-178US2_ST25.TXT, created on Jun. 10, 2019, with a size of 2.66 megabytes, machine format IBM-PC, MS-Windows operating system, is hereby incorporated by reference.

FIELD OF THE INVENTION

The present invention provides engineered tyrosine ammonia-lyase (TAL) polypeptides and compositions thereof. In some embodiments, the engineered TAL polypeptides have been optimized to provide enhanced catalytic activity, and enhanced acid stability, while reducing sensitivity to proteolysis and increasing tolerance to acidic pH levels. The invention also provides methods for utilization of the compositions comprising the engineered TAL polypeptides for therapeutic and industrial purposes.

BACKGROUND OF THE INVENTION

Tyrosine ammonia lyase (TAL; also referred to as tyrase, L-tyrosine ammonia lyase, and "L-tyrosine ammonia lyase [trans-p-hyroxycinnamate forming]"), along with histidine ammonia lyase (HAL) and phenylalanine ammonia-lyase (PAL) are members of the aromatic amino acid lyase family (EC 4.3.1.23-1.25 and 4.3.1.3). The enzymes having TAL activity are currently classified in EC4.3.1.23 (previously classified as EC 4.3.1.5). TAL catalyzes the formation of p-coumaric acid from L-tyrosine.

Tyrosinemia (also referred to as "hereditary tyrosinemia," and "hypertyrosinemia") is a genetic disorder characterized by elevated blood levels of tyrosine, due to the deficiency of an enzyme required for the catabolism of tyrosine in the liver. If untreated, tyrosine and other metabolites accumulate in the tissues and organs of affected individuals, resulting in serious medical issues. Tyrosinemia is an inborn error of metabolism inherited in an autosomal recessive pattern. There are three types of tyrosinemia, each caused by the deficiency of a different enzyme. Currently used treatment methods depend upon the type of tyrosinemia involved. A low protein diet is often used.

Type I tyrosinemia (also referred to as "FAH deficiency," "fumaryl acetoacetase deficiency," "fumaryl aceotacetate hydrolase deficiency," "hereditary infantile tyrosinemia," and "hepatorenal tyrosinemia") is caused by a deficiency of fumarylacetoacetate hydrolase, due to mutations in the fah gene. This is the most severe form of the disease, with symptoms usually appearing in the first few months of life, commonly including failure to thrive, diarrhea, bloody stools, vomiting, jaundice, enlarged liver, the tendency to easily bruise, lethargy, irritability, fever, and other symptoms, such as a distinctive cabbage-like odor of the skin and urine. Some affected infants have repeated neurologic episodes of acute polyneuropathy, characterized by severe leg pain, as well as altered mental status, abdominal pain, and respiratory failure. Infants with the acute form are typically affected at birth and there is a rapid onset of symptoms that can lead to developmental delays, enlarged spleen, ascites, kidney disease, and blood clotting abnormalities. Untreated, it can lead to hepatic and renal failure, nervous system problems, and an increased risk of liver cancer (e.g., hepatocellular carcinoma). In some cases, hypertension and hypertrophic cardiomyopathy are present. If untreated, this disease can be fatal. In the less-common chronic form, the symptoms exhibit a more gradual onset and tend to be less severe. Affected infants initially exhibit vomiting, diarrhea, enlarged liver and spleen, and failure to thrive. Eventually, progressive liver cirrhosis occurs, leading to chronic liver failure, developmental delays, and renal Fanconi syndrome (a rare kidney disorder characterized by weakening and softening of the bones [rickets], vomiting, dehydration, weakness, and fever). In some cases, the most effective treatment has been full or partial liver transplant. Worldwide, this form affects approximately 1 in 100,000 human births (Genetics Home Reference, U.S. National Library of Medicine).

Type II tyrosinemia (also referred to as "keratosis palmoplantaris-corneal dystrophy," oculocutaneous tyrosinemia," "Richner-Hanhart syndrome," "tyrosinemia due to TAT deficiency," and "tyrosinemia due to tyrosine aminotransferase deficiency,") is caused by a deficiency of tyrosine aminotransferase, due to mutations in the tat gene. It affects the eyes, skin, and mental development. As with Type 1 tyrosinemia, symptoms usually begin in early life, and include excessive tearing, photophobia, eye pain and redness, and painful skin lesions on the palms and soles. About half of affected individuals have some level of intellectual disability. This form occurs in less than 1 in 250,000 persons (Genetics Home Reference, supra).

Type III tyrosinemia (also referred to as "tyrosinemia due to 4-hydroxyphenylpyruvate dioxygenase deficiency," "tyrosinemia due to 4-hydroxyphenylpyuriv acid oxidase deficiency," and "tyrosinemia due to HPD deficiency") is a rare disorder, caused by a deficiency of 4-hydroxyphenylpyruvate dioxygenase, due to mutations in the hpd gene. Symptoms of this form include intellectual disability, seizures, and intermittent ataxia. This form is very rare, only a few cases have been reported (Genetics Home Reference, supra).

There are additional cases in which there are temporary elevated tyrosine levels, due to non-genetic factors such as vitamin C deficiency or premature birth, which results in immature liver enzymes. Differential diagnoses are used to differentiate these transient cases from tyrosinemia I, II, or III.

In addition to tyrosinemia, there are other diseases associated with insufficient or absent tyrosine metabolism. For example, alkaptonuria also referred to as alcaptonuria, is a disease caused by deficiency of homogentisate 1,2-dioxygenase, which is an enzyme involved in tyrosine degradation. This enzyme is encoded by the HGD gene. Insufficient activity of this enzyme results in the accumulation of homogentisic acid. Excess homogentisic acid and related compounds are deposited in connective tissues, causing the cartilage and skin to darken. Over time, arthritis may result due to the accumulation of homogentisic acid and related metabolites in the joints of affected individuals. Homogentisic acid is also excreted in urine, making the urine turn black. Alkaptonuria is a rare disease that affects 1 in 250,000 to 1,000,000 people worldwide (See, Genetics Home Reference, supra).

Treatment of these diseases has largely been the life-long use of a phenylalanine-, and tyrosine-restricted diet. Treatment with nitisinone (NTBC; 2-(2-nitro-4-trifluoromethylbenzol)-1,3-cyclohexane dione; Orfadin®) has been reported to be helpful for type I tyrosinemia and alkaptonuria, due to its inhibition of the 4-hydroxyphenylpyruvate oxidase pathway. However, NTBC must be used in combination with a challenging and costly phenylalanine-, and tyrosine-restricted diet to prevent both liver failure and carcinogenesis. There remains a need in the art for easy to administer, effective treatment(s) to ameliorate the symptoms of these diseases and allow patients to utilize normal diets.

SUMMARY OF THE INVENTION

The present invention provides engineered tyrosine ammonia-lyase (TAL) polypeptides and compositions thereof. In some embodiments, the engineered TAL polypeptides have been optimized to provide enhanced catalytic activity and enhanced acid stability, while reducing sensitivity to proteolysis and increasing tolerance to acidic pH levels. The invention also provides methods for utilization of the compositions comprising the engineered TAL polypeptides for therapeutic and industrial purposes.

In some embodiments, the present invention provides engineered TAL polypeptides (also referred to herein as "recombinant TAL polypeptides") and biologically active fragments and analogs thereof having improved properties when compared to a wild-type TAL enzyme and/or a reference TAL polypeptide under essentially the same conditions. The invention is further directed to methods of using the engineered TAL polypeptides and biologically active fragments and analogs thereof in therapeutic and/or industrial compositions.

The present invention provides recombinant tyrosine ammonia lyases and/or biologically active recombinant tyrosine ammonia lyase fragments comprising amino acid sequences comprising at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to SEQ ID NO: 2, 6, 28, 92, 308, 338, 504, and/or 736.

In some embodiments, the recombinant tyrosine ammonia lyase comprises at least one substitution at a position or set of positions selected from 16/18/39/47/54/59/73/91/209/214/285/290/305/307/364/407/503/521/524/565, 16/18/39/47/54/59/73/91/209/214/285/290/307/364/407/450/470/503/521/524/565, 16/18/39/47/54/59/73/91/209/214/285/290/407/503/521/524/565, 16/18/39/47/54/59/73/91/209/214/290/305/307/364/407/470/503/521/524/565, 16/18/39/47/54/59/73/91/209/285/290/307/364/407/450/470/503/521/524/565, 16/18/39/47/54/59/73/91/214/285/290/364/403/407/450/470/503/521/524, 16/18/39/47/54/59/73/91/285/290/305/307/364/407/470/503/521/524/565, 16/18/39/54/73/91/209/210/285/290/307/364/407/450/470/503/521/524, 16/39/47/54/59/73/91/98/209/214/285/290/307/407/450/470/503, 16/39/47/54/59/73/91/209/214/285/290/305/307/364/407/450/470/521/524/565, 16/39/47/54/59/73/91/209/214/285/290/305/307/364/407/450/503/521/565, 16/39/47/54/59/73/91/209/214/285/290/305/307/364/407/470/503/521, 16/39/47/54/59/73/91/209/214/285/290/305/307/364/407/470/503/521/524/565, 16/39/47/54/59/73/91/209/214/285/290/305/364/503/524/565, 16/39/47/54/59/73/91/209/214/285/290/307/364/407/470/503/521/524/565, 16/39/47/54/59/73/91/209/285/290/305/307/364/407/470/503/521/524/565, 16/39/47/54/59/73/209/214/285/290/307/364/470/503/521/524/565, 16/39/54/59/73/91/209/214/285/290/364/450/470/503/521/524, 16/54/59/73/91/209/214/285/290/307/364/407/450/503/521/524/565, 18/39/47/54/59/73/91/209/214/285/290/305/307/364/407/503/521/524, 18/39/47/54/59/73/91/209/214/285/290/305/307/364/407/503/521/524/565, 18/39/47/54/59/73/91/285/290/305/307/364/407/470/521/524/565, 18/39/47/54/59/91/209/214/285/290/307/364/407/450/470/503/521/524/565, 18/39/47/54/73/91/98/209/214/285/290/305/307/364/407/470/503/521/524, 18/39/47/54/73/91/209/214/285/290/305/364/407/470/503/521/524, 18/39/47/54/73/91/209/285/290/305/307/364/407/470/503/521/524, 18/39/54/59/73/91/209/214/285/290/307/364/407/470/503/521/524/565, 18/47/54/59/73/91/285/290/307/364/470/503/521/524/565, 39/47/54/59/73/91/209/210/285/290/307/364/407/450/470/503/521/524/565, 39/47/54/73/91/209/214/285/290/364/407/450/470/503/521/524/565, 39/47/59/73/91/209/214/285/290/305/307/364/407/470/503/521/524/565, 39/54/59/73/91/209/214/285/290/364/407/470/503/524/565, and 39/54/59/73/91/285/290/307/450/470/503/524/565, wherein the positions are numbered with reference to SEQ ID NO: 6. In some embodiments, the tyrosine ammonia lyase comprises at least one substitution or set of substitutions selected from 16S/18H/39V/47A/54K/59R/73K/91V/209P/214Q/285L/290G/305M/307G/364H/407V/503Q/521K/524S/565P, 16S/18H/39V/47A/54K/59R/73K/91V/209P/214Q/285L/290G/307G/364H/407V/450A/470E/503Q/5 21K/524S/565P, 16S/18H/39V/47A/54K/59R/73K/91V/209P/214Q/285L/290G/407V/503Q/521K/524S/565P, 16S/18H/39V/47A/54K/59R/73K/91V/209P/214Q/290G/305M/307G/364H/407V/470E/503Q/521K/524S/565P, 16S/18H/39V/47A/54K/59R/73K/91V/209P/285L/290G/307G/364H/407V/450A/470E/503Q/521K/5 24S/565P, 16S/18H/39V/47A/54K/59R/73K/91V/214Q/285L/290G/364H/403T/407V/450A/470E/503Q/521K/5 24S, 16S/18H/39V/47A/54K/59R/73K/91V/285L/290G/305M/307G/364H/407V/470E/503Q/521K/524S/565P, 16S/18H/39V/54K/73K/91V/209P/210S/285L/290G/307G/364H/407V/450A/470E/503Q/521K/524S, 16S/39V/47A/54K/59R/73K/91V/98G/209P/214Q/285L/290G/307G/407V/450A/470E/503Q, 16S/39V/47A/54K/59R/73K/91V/209P/214Q/285L/290G/305M/307G/364H/407V/450A/470E/521K/524S/565P, 16S/39V/47A/54K/59R/73K/91V/209P/214Q/285L/290G/305M/307G/364H/407V/450A/503Q/521K/565P, 16S/39V/47A/54K/59R/73K/91V/209P/214Q/285L/290G/305M/307G/364H/407V/470E/503Q/521K, 16S/39V/47A/54K/59R/73K/91V/209P/214Q/285L/290G/305M/307G/364H/407V/470E/503Q/521K/524S/565P, 16S/39V/47A/54K/59R/73K/91V/209P/214Q/285L/290G/305M/364H/503Q/524S/565P, 16S/39V/47A/54K/59R/73K/91V/209P/214Q/285L/290G/307G/364H/407V/470E/503Q/521K/524S/565P, 16S/39V/47A/54K/59R/73K/91V/209P/285L/290G/305M/307G/364H/407V/470E/503Q/521K/524S/565P, 16S/39V/47A/54K/59R/73K/209P/214Q/285L/290G/307G/364H/470E/503Q/521K/524S/565P, 16S/39V/54K/59R/73K/91V/209P/214Q/285L/290G/364H/450A/470E/503Q/521K/524S, 16S/54K/59R/73K/91V/209P/214Q/285L/290G/307G/364H/407V/450A/503Q/521K/524S/565P, 18H/39V/47A/54K/59R/73K/91V/209P/214Q/285L/290G/305M/307G/364H/407V/503Q/521K/524, 18H/39V/47A/54K/59R/73K/91V/209P/214Q/285L/290G/305M/307G/364H/407V/503Q/521K/524S/565P, 18H/39V/47A/54K/59R/73K/91V/285L/290G/305M/307G/364H/407V/470E/521K/524S/565P, 18H/39V/47A/54K/59R/91V/209P/214Q/285L/290G/307G/364H/407V/450A/470E/503Q/521K/524S/565P, 18H/39V/47A/54K/73K/91V/98G/209P/214Q/285L/290G/305M/307G/364H/407V/470E/503Q/521K/524S, 18H/39V/47A/54K/73K/91V/209P/214Q/285L/290G/

305M/364H/407V/470E/503Q/521K/524S, 18H/39V/47A/ 54K/73K/91V/209P/285L/290G/305M/307G/364H/407V/ 470E/503Q/521K/524S, 18H/39V/54K/59R/73K/91V/ 209P/214Q/285L/290G/307G/364H/407V/470E/503Q/ 521K/524S/565P, 18H/47A/54K/59R/73K/91V/285L/ 290G/307G/364H/470E/503Q/521K/524S/565P, 39V/47A/ 54K/59R/73K/91V/209P/210S/285L/290G/307G/364H/ 407V/450A/470E/503Q/521K/524S/565P, 39V/47A/54K/ 73K/91V/209P/214Q/285L/290G/364H/407V/450A/470E/ 503Q/521K/524S/565P, 39V/47A/59R/73K/91V/209P/ 214Q/285L/290G/305M/307G/364H/407V/470E/503Q/ 521K/524S/56 5P, 39V/54K/59R/73K/91V/209P/214Q/ 285L/290G/364H/407V/470E/503Q/524S/565P, and 39V/ 54K/59R/73K/91V/285L/290G/307G/450A/470E/503Q/ 524S/565P, wherein the positions are numbered with reference to SEQ ID NO: 6. In some embodiments, the recombinant tyrosine ammonia lyase comprises at least one substitution in at least one position or set of positions selected from F16S/F18H/A39V/L47A/T54K/G59R/S73K/ A91V/S209P/L214Q/1285L/N290G/R305M/H307G/ L364H/L407V/C503Q/Q521K/T524S/C565P, F16S/F18H/ A39V/L47A/T54K/G59R/S73K/A91V/S209P/L214Q/ 1285L/N290G/H307G/L364H/L407V/F450A/D470E/ C503Q/Q521K/T524S/C565P, F16S/F18H/A39V/L47A/ T54K/G59R/S73K/A91V/S209P/L214Q/1285L/N290G/ L407V/C503Q/Q521K/T524S/C565P, F16S/F18H/A39V/ L47A/T54K/G59R/S73K/A91V/S209P/L214Q/N290G/ R305M/H307G/L364H/L407V/D470E/C503Q/Q521K/ T524S/C565P, F16S/F18H/A39V/L47A/T54K/G59R/ S73K/A91V/S209P/1285L/N290G/H307G/L364H/L407V/ F450A/D470E/C503Q/Q521K/T524S/C565P, F16S/F18H/ A39V/L47A/T54K/G59R/S73K/A91V/L214Q/1285L/ N290G/L364H/P403T/L407V/F450A/D470E/C503Q/ Q521K/T524S, F16S/F18H/A39V/L47A/T54K/G59R/ S73K/A91V/1285L/N290G/R305M/H307G/L364H/ L407V/D470E/C503Q/Q521K/T524S/C565P, F16S/F18H/ A39V/T54K/S73K/A91V/S209P/P210S/1285L/N290G/ H307G/L364H/L407V/F450A/D470E/C503Q/Q521K/ T524S, F16S/A39V/L47A/T54K/G59R/S73K/A91V/S98G/ S209P/L214Q/1285L/N290G/H307G/L407V/F450A/ D470E/C503Q, F16S/A39V/L47A/T54K/G59R/S73K/ A91V/S209P/L214Q/1285L/N290G/R305M/H307G/ L364H/L407V/F450A/D470E/Q521K/T524S/C565P, F16S/A39V/L47A/T54K/G59R/S73K/A91V/S209P/ L214Q/1285L/N290G/R305M/H307G/L364H/L407V/ F450A/C503Q/Q521K/C565P, F16S/A39V/L47A/T54K/ G59R/S73K/A91V/S209P/L214Q/1285L/N290G/R305M/ H307G/L364H/L407V/D470E/C503Q/Q521K, F16S/ A39V/L47A/T54K/G59R/S73K/A91V/S209P/L214Q/ 1285L/N290G/R305M/H307G/L364H/L407V/D470E/ C503Q/Q521K/T524S/C565P, F16S/A39V/L47A/T54K/ G59R/S73K/A91V/S209P/L214Q/1285L/N290G/R305M/ L364H/C503Q/T524S/C565P, F16S/A39V/L47A/T54K/ G59R/S73K/A91V/S209P/L214Q/1285L/N290G/H307G/ L364H/L407V/D470E/C503Q/Q521K/T524S/C565P, F16S/A39V/L47A/T54K/G59R/S73K/A91V/S209P/ 1285L/N290G/R305M/H307G/L364H/L407V/D470E/ C503Q/Q521K/T524S/C565P, F16S/A39V/L47A/T54K/ G59R/S73K/S209P/L214Q/1285L/N290G/H307G/L364H/ D470E/C503Q/Q521K/T524S/C565P, F16S/A39V/T54K/ G59R/S73K/A91V/S209P/L214Q/1285L/N290G/L364H/ F450A/D470E/C503Q/Q521K/T524S, F16S/T54K/G59R/ S73K/A91V/S209P/L214Q/1285L/N290G/H307G/L364H/ L407V/F450A/C503Q/Q521K/T524S/C565P, F18H/A39V/ L47A/T54K/G59R/S73K/A91V/S209P/L214Q/1285L/ N290G/R305M/H307G/L364H/L407V/C503Q/Q521K/ T524S, F18H/A39V/L47A/T54K/G59R/S73K/A91V/ S209P/L214Q/1285L/N290G/R305M/H307G/L364H/ L407V/C503Q/Q521K/T524S/C565P, F18H/A39V/L47A/ T54K/G59R/S73K/A91V/1285L/N290G/R305M/H307G/ L364H/L407V/D470E/Q521K/T524S/C565P, F18H/A39V/ L47A/T54K/G59R/A91V/S209P/L214Q/1285L/N290G/ H307G/L364H/L407V/F450A/D470E/C503Q/Q521K/ T524S/C565P, F18H/A39V/L47A/T54K/S73K/A91V/ S98G/S209P/L214Q/1285L/N290G/R305M/H307G/ L364H/L407V/D470E/C503Q/Q521K/T524S, F18H/ A39V/L47A/T54K/S73K/A91V/S209P/L214Q/1285L/ N290G/R305M/L364H/L407V/D470E/C503Q/Q521K/ T524S, F18H/A39V/L47A/T54K/S73K/A91V/S209P/ 1285L/N290G/R305M/H307G/L364H/L407V/D470E/ C503Q/Q521K/T524S, F18H/A39V/T54K/G59R/S73K/ A91V/S209P/L214Q/1285L/N290G/H307G/L364H/ L407V/D470E/C503Q/Q521K/T524S/C565P, F18H/L47A/ T54K/G59R/S73K/A91V/1285L/N290G/H307G/L364H/ D470E/C503Q/Q521K/T524S/C565P, A39V/L47A/T54K/ G59R/S73K/A91V/S209P/P210S/1285L/N290G/H307G/ L364H/L407V/F450A/D470E/C503Q/Q521K/T524S/ C565P, A39V/L47A/T54K/S73K/A91V/S209P/L214Q/ 1285L/N290G/L364H/L407V/F450A/D470E/C503Q/ Q521K/T524S/C565P, A39V/L47A/G59R/S73K/A91V/ S209P/L214Q/1285L/N290G/R305M/H307G/L364H/ L407V/D470E/C503Q/Q521K/T524S/C565P, A39V/T54K/ G59R/S73K/A91V/S209P/L214Q/1285L/N290G/L364H/ L407V/D470E/C503Q/T524SC565P, and A39V/T54K/ G59R/S73K/A91V/1285L/N290G/H307G/F450A/D470E/ C503Q/T524S/C565P, wherein the positions are numbered with reference to SEQ ID NO: 6.

In some embodiments, the recombinant tyrosine ammonia lyase comprises at least one substitution in at least one position or set of positions selected from 18/222, 18/222/ 364/400, 18/222/400/490, 18/364/400, 18/364/453, 18/389/ 400/490, 18/389/490, 18/400, 77/222/389, 222/364/389, 222/453, 315, 315/364, 315/389/453, 389/400, 400, and 400/453, wherein the positions are numbered with reference to SEQ ID NO: 28. In some further embodiments, the recombinant tyrosine ammonia lyase comprises at least one substitution or substitution set selected from 18H/222T, 18H/222T/364M/400M, 18H/222T/400M/490T, 18H/ 364M/400M, 18H/364M/453C, 18H/389T/400M/490T, 18H/389T/490T, 18H/400M, 77M/222T/389T, 222T/364M/ 389T, 222T/453C, 315A, 315A/364M, 315A/389T/453C, 389T/400M, 400M, and 400M/453C, wherein the positions are numbered with reference to SEQ ID NO: 28. In some additional embodiments, the recombinant tyrosine ammonia lyase comprises at least one substitution or substitution set selected from F18H/M222T, F18H/M222T/H364M/ N400M, F18H/M222T/N400M/R490T, F18H/H364M/ N400M, F18H/H364M/N453C, F18H/Q389T/N400M/ R490T, F18H/Q389T/R490T, F18H/N400M, I77M/M222T/ Q389T, M222T/H364M/Q389T, M222T/N453C, S315A, S315A/H364M, S315A/Q389T/N453C, Q389T/N400M, N400M, and N400M/N453C, wherein the positions are numbered with reference to SEQ ID NO: 28.

In some additional embodiments, the recombinant tyrosine ammonia lyase comprises at least one substitution in at least one position or set of positions selected from 43/410/ 413, 49/114/204/425, 61, 72, 72/306/307, 72/306/309, 73, 98, 98/404/410, 104, 106, 110, 112, 114, 114/145/204/258/ 275, 114/145/204/275/424/435, 114/145/247, 114/145/275, 114/145/275/344/424/435, 114/176, 114/176/518, 114/204, 114/204/247/258, 114/204/258/424/435, 114/204/266/425, 114/204/275/425, 114/204/275/518, 114/204/344, 114/204/ 435, 114/204/435/518, 114/204/518, 114/247/275/344/518, 114/258/275, 114/258/424/425/518, 114/518, 119/404/410, 145/204/275/435, 145/258/275/518, 145/424/435, 145/435, 175, 176/204, 176/204/518, 176/247, 176/247/258, 176/258/ 518, 176/275, 176/518, 204, 204/247/258/275, 204/247/435, 204/247/518, 204/258/275, 204/275/344, 204/518, 214, 247, 247/258, 247/258/518, 247/275/344/518, 247/424/435, 247/ 518, 258/344, 258/435, 275, 275/344, 306, 306/307/309, 306/307/394, 306/307/394/404/410, 306/410, 307, 344, 344/ 424/435/518, 345, 378/407, 394/410, 394/413, 395, 407, 410, 410/517, 413, 413/557, 418, 424, 424/435, 435, 435/ 518, 450, 464, and 518, wherein the positions are numbered with reference to SEQ ID NO: 92. In some embodiments, the recombinant tyrosine ammonia lyase comprises at least one substitution or set of substitutions selected from 43S/410S/ 413P, 49R/114K/204E/425A, 61P, 72A, 72A/306G/307E, 72A/306G/309P, 73A, 73N, 98G, 98K, 98K/404A/4105, 104M, 106H, 110V, 112N, 112V, 114K, 114K/145Q/204E/ 258Q/275T, 114K/145Q/204E/275T/424T/435L, 114K/ 145Q/247L, 114K/145Q/275T, 114K/145Q/275T/344A/ 424T/435L, 114K/176H, 114K/176H/5181, 114K/204E, 114K/204E/247L/258Q, 114K/204E/258Q/424T/435L, 114K/204E/266Q/425A, 114K/204E/275T/425A, 114K/ 204E/275T/518I, 114K/204E/344A, 114K/204E/435L, 114K/204E/435L/518I, 114K/204E/518I, 114K/247L/275T/ 344A/518I, 114K/258Q/275T, 114K/258Q/424T/425A/ 518I, 114K/518I, 119S/404A/410S, 145Q/204E/275T/435L, 145Q/258Q/275T/518I, 145Q/424T/435L, 145Q/435L, 175G, 176H/204E, 176H/204E/518I, 176H/247L, 176H/ 247L/258Q, 176H/258Q/518I, 176H/275T, 176H/518I, 204E, 204E/247L/258Q/275T, 204E/247L/435L, 204E/ 247L/518I, 204E/258Q/275T, 204E/275T/344A, 204E/518I, 214A, 214H, 214L, 247L, 247L/258Q, 247L/258Q/518I, 247L/275T/344A/518I, 247L/424T/435L, 247L/518I, 258Q/344A, 258Q/435L, 275T, 275T/344A, 306G, 306G/ 307E/309P, 306G/307E/394T, 306G/307E/394T/404A/ 410S, 306G/410S, 306P, 307A, 344A, 344A/424T/435L/ 518I, 345C, 378H/407L, 394T/410S, 394T/413P, 395A, 407L, 410F, 410P, 410S, 410V, 410V/517N, 413P, 413T, 413T/557K, 418M, 424T, 424T/435L, 435L, 435L/518I, 450Y, 464M, and 518I, wherein the positions are numbered with reference to SEQ ID NO: 92. In some embodiments, the recombinant tyrosine ammonia lyase comprises at least one substitution or substitution set selected from R43S/R410S/ K413P, S49R/N114K/R204E/G425A, Q61P, E72A, E72A/ D306G/G307E, E72A/D306G/L309P, K73A, K73N, S98G, S98K, S98K/P404A/R4105, L104M, W106H, T110V, A112N, A112V, N114K, N114K/K145Q/R204E/N258Q/ P275T, N114K/K145Q/R204E/P275T/C424T/Y435L, N114K/K145Q/M247L, N114K/K145Q/P275T, N114K/ K145Q/P275T/V344A/C424T/Y435L, N114K/Y176H, N114K/Y176H/V518I, N114K/R204E, N114K/R204E/ M247L/N258Q, N114K/R204E/N258Q/C424T/Y435L, N114K/R204E/P266Q/G425A, N114K/R204E/P275T/ G425A, N114K/R204E/P275T/V518I, N114K/R204E/ V344A, N114K/R204E/Y435L, N114K/R204E/Y435L/ V518I, N114K/R204E/V518I, N114K/M247L/P275T/ V344A/V518I, N114K/N258Q/P275T, N114K/N258Q/ C424T/G425A/V518I, N114K/V518I, A119S/P404A/ R410S, K145Q/R204E/P275T/Y435L, K145Q/N258Q/ P275T/V518I, K145Q/C424T/Y435L, K145Q/Y435L, S175G, Y176H/R204E, Y176H/R204E/V518I, Y176H/ M247L, Y176H/M247L/N258Q, Y176H/N258Q/V518I, Y176H/P275T, Y176H/V518I, R204E, R204E/M247L/ N258Q/P275T, R204E/M247L/Y435L, R204E/M247L/ V518I, R204E/N258Q/P275T, R204E/P275T/V344A, R204E/V518I, Q214A, Q214H, Q214L, M247L, M247L/ N258Q, M247L/N258Q/V518I, M247L/P275T/V344A/ V518I, M247L/C424T/Y435L, M247L/V518I, N258Q/

V344A, N258Q/Y435L, P275T, P275T/V344A, D306G, D306G/G307E/L309P, D306G/G307E/A394T, D306G/ G307E/A394T/P404A/R410S, D306G/R410S, D306P, G307A, V344A, V344A/C424T/Y435L/V518I, T345C, Y378H/V407L, A394T/R410S, A394T/K413P, S395A, V407L, R410F, R410P, R410S, R410V, R410V/H517N, K413P, K413T, K413T/Q557K, L418M, C424T, C424T/ Y435L, Y435L, Y435L/V518I, F450Y, L464M, and V518I, wherein the positions are numbered with reference to SEQ ID NO: 92.

In some embodiments, the recombinant tyrosine ammonia lyase comprises at least one substitution in at least one position or set of positions selected from 27, 31, 32/119/ 237/513/534, 32/119/509/513/534, 36, 54, 56, 58, 61, 61/214/464, 68, 69, 114, 114/119, 114/410/413/418, 118, 119/145/237/331, 119/237/254/513, 119/331/509/513, 119/ 509/513, 145/237/509/513/534, 158/509/513/534, 158/534, 189, 193, 209, 214, 214/410/450/464, 237, 237/254/331, 237/509/513, 237/513, 237/513/534, 249/339, 266, 270, 270/532, 282, 286, 289, 289/517, 331, 335, 338, 339, 353, 354, 355, 394/410/464, 394/464, 410/418/450/464, 418, 464, 467, 470, 497, 502, 509/513, 509/513/534, 513/534, 517, 522, 524, 525, 547, 551, 554, and 560, wherein the positions are numbered with reference to SEQ ID NO: 308. In some embodiments, the recombinant tyrosine ammonia lyase comprises at least one substitution or substitution set selected from 27D, 27G, 31D, 32D/119E/237H/513E/534D, 32D/119E/509L/513E/534D, 36A, 36E, 54P, 54T, 56P, 58A, 61P, 61P/214A/464M, 61S, 68F, 69D, 114G, 114K/119S, 114K/410V/413P/418M, 118T, 119E/145Q/237H/331E, 119E/237H/254L/513E, 119E/331E/509L/513E, 119E/ 509L/513E, 145Q/237H/509L/513E/534D, 158V/509L/ 513E/534D, 158V/534D, 189T, 193L, 209G, 209V, 214A, 214A/410P/450Y/464M, 237F, 237H, 237H/254L/331E, 237H/509L/513E, 237H/513E, 237H/513E/534D, 237M, 237R, 249A/339L, 266T, 270E/532D, 270T, 282E, 282G, 286G, 289E/517Q, 289Q, 331E, 331G, 331H, 331P, 335G, 338D, 339C, 339T, 353L, 354V, 355K, 355R, 394T/410P/ 464M, 394T/464M, 410V/418M/450Y/464M, 418M, 464M, 467G, 470G, 497G, 497M, 502D, 502G, 502S, 509L/513E, 509L/513E/534D, 513E/534D, 517G, 522A, 522G, 522P, 524T, 524V, 525G, 547D, 547H, 551C, 551E, 551Q, 551T, 554Q, 560E, 560R, and 560S, wherein the positions are numbered with reference to SEQ ID NO: 308. In some embodiments, the recombinant tyrosine ammonia lyase comprises at least one substitution or substitution set selected from I27D, I27G, Q31D, K32D/A119E/Y237H/ S513E/N534D, K32D/A119E/E509L/S513E/N534D, N36A, N36E, K54P, K54T, I56P, Q58A, Q61P, Q61P/ Q214A/L464M, Q61S, N68F, N69D, N114G, N114K/ A119S, N114K/S410V/K413P/L418M, L118T, A119E/ K145Q/Y237H/S331E, A119E/Y237H/I254L/S513E, A119E/S331E/E509L/S513E, A119E/E509L/S513E, K145Q/Y237H/E509L/S513E/N534D, Y158V/E509L/ S513E/N534D, Y158V/N534D, K189T, N193L, P209G, P209V, Q214A, Q214A/S410P/F450Y/L464M, Y237F, Y237H, Y237H/I254L/S331E, Y237H/E509L/S513E, Y237H/S513E, Y237H/S513E/N534D, Y237M, Y237R, V249A/I339L, P266T, N270E/N532D, N270T, D282E, D282G, S286G, A289E/H517Q, A289Q, S331E, S331G, S331H, S331P, K335G, E338D, I339C, I339T, D353L, N354V, Q355K, Q355R, A394T/S410P/L464M, A394T/ L464M, S410V/L418M/F450Y/L464M, L418M, L464M, R467G, E470G, H497G, H497M, A502D, A502G, A5025, E509L/S513E, E509L/S513E/N534D, S513E/N534D, H517G, K522A, K522G, K522P, S524T, S524V, S525G, A547D, A547H, A551C, A551E, A551Q, A551T, V554Q, Q560E, Q560R, and Q560S, wherein the positions are numbered with reference to SEQ ID NO: 308.

In some further embodiments, the recombinant tyrosine ammonia lyase comprises at least one substitution in at least one position or set of positions selected from 27/31/54, 27/31/502/534, 27/31/502/N534D, 27/282/410, 31/54, 31/54/237/282, 31/54/282/335/502, 31/237/335, 31/237/335/502, 31/282, 31/335, 31/410, 31/502, 31/534/547, 36/114/119/289/554, 54/237, 54/335/355/410/502, 61/114/119/286/289/551/554, 61/119/339/551/554, 114, 114/119/254/289, 114/119/254/289/551, 114/119/339/364, 114/119/554, 114/286/339/418, 114/364/554, 119/254/286/339/364/418/551, 119/254/289/554, 119/339/364/418/551, 119/339/554, 119/418/551/554, 119/551/554, 119/554, 237/282/410/502, 237/410/502, 237/517, 254, 254/286/289/554, 254/289/339/418/554, 254/418, 282/410, 282/410/502/517/547, 282/502, 286/289, 286/289/418/554, 289, 289/551, 335/410, 339/418/551, 410/547, 502, and 554, wherein the positions are numbered with reference to SEQ ID NO: 338. In some embodiments, the recombinant tyrosine ammonia lyase comprises at least one substitution or substitution set selected from 27G/31D/54P, 27G/31D/502G/534D, 27G/282E/410P, 31D/54P, 31D/54P/237M/282E, 31D/54P/282E/335G/502G, 31D/237M/335G/502G, 31D/237R/335G, 31D/282E, 31D/335G, 31D/410P, 31D/502G, 31D/534D/547D, 36A/114G/119E/289Q/554Q, 54P/237M, 54P/237R, 54P/335G/355K/410P/502G, 61P/114G/119E/286G/289Q/551Q/554Q, 61P/119E/339T/551Q/554Q, 114G, 114G/119E/254I/289Q, 114G/119E/254I/289Q/551Q, 114G/119E/339T/364M, 114G/119E/554Q, 114G/286G/339T/418M, 114G/364M/554Q, 119E/254I/286G/339T/364M/418M/551Q, 119E/254I/289Q/554Q, 119E/339T/364M/418M/551Q, 119E/339T/554Q, 119E/418M/551Q/554Q, 119E/551Q/554Q, 119E/554Q, 237M/410P/502G, 237M/517G, 237R/282E/410P/502G, 254I, 254I/286G/289Q/554Q, 254I/289Q/339T/418M/554Q, 254I/418M, 282E/410P, 282E/410P/502G/517G/547D, 282E/502G, 286G/289Q, 286G/289Q/418M/554Q, 289Q, 289Q/551Q, 335G/410P, 339T/418M/551Q, 410P/547D, 502G, and 554Q, wherein the positions are numbered with reference to SEQ ID NO: 338. In some embodiments, the recombinant tyrosine ammonia lyase comprises at least one substitution or substitution set selected from I27G/Q31D/K54P, I27G/Q31D/A502G/N534D, I27G/D282E/S410P, Q31D/K54P, Q31D/K54P/H237M/D282E, Q31D/K54P/D282E/K335G/A502G, Q31D/H237M/K335G/A502G, Q31D/H237R/K335G, Q31D/D282E, Q31D/K335G, Q31D/S410P, Q31D/A502G, Q31D/N534D/A547D, N36A/N114G/A119E/A289Q/V554Q, K54P/H237M, K54P/H237R, K54P/K335G/Q355K/S410P/A502G, Q61P/N114G/A119E/S286G/A289Q/A551Q/V554Q, Q61P/A119E/I339T/A551Q/V554Q, N114G, N114G/A119E/L254I/A289Q, N114G/A119E/L254I/A289Q/A551Q, N114G/A119E/I339T/H364M, N114G/A119E/V554Q, N114G/S286G/I339T/L418M, N114G/H364M/V554Q, A119E/L254I/S286G/I339T/H364M/L418M/A551Q, A119E/L254I/A289Q/V554Q, A119E/I339T/H364M/L418M/A551Q, A119E/I339T/V554Q, A119E/L418M/A551Q/V554Q, A119E/A551Q/V554Q, A119E/V554Q, H237M/S410P/A502G, H237M/H517G, H237R/D282E/S410P/A502G, L254I, L254I/S286G/A289Q/V554Q, L254I/A289Q/I339T/L418M/V554Q, L254I/L418M, D282E/S410P, D282E/S410P/A502G/H517G/A547D, D282E/A502G, S286G/A289Q, S286G/A289Q/L418M/V554Q, A289Q, A289Q/A551Q, K335G/S410P, I339T/L418M/A551Q, S410P/A547D, A502G, and V554Q, wherein the positions are numbered with reference to SEQ ID NO: 338.

In some additional embodiments, the recombinant tyrosine ammonia lyase comprises at least one substitution in at least one position or set of positions selected from 116, 130, 133, 136, 158, 162, 211, 251, 267, 280, 319, 343, 356, 366, 367, 369, 386, 390, 403, 428, 439, 440, 443, 444, 462, 463, 474, 477, 478, 479, 481, 530, and 541, wherein the positions are numbered with reference to SEQ ID NO: 338. In some embodiments, the recombinant tyrosine ammonia lyase comprises at least one substitution in at least one position or set of positions selected from 116M, 116V, 130C, 133T, 136Q, 158H, 158I, 158L, 158Q, 158S, 158W, 162H, 162Y, 211V, 251S, 267Y, 280V, 319A, 343A, 356H, 366E, 367A, 367C, 367S, 369S, 386V, 390V, 403T, 428M, 439L, 440S, 443Y, 444A, 462S, 463E, 463F, 463G, 463L, 463M, 463N, 474C, 474E, 474F, 474G, 474H, 474R, 474S, 474T, 477S, 478A, 478L, 478V, 479G, 479S, 481L, 530L, 530V, and 541M, wherein the positions are numbered with reference to SEQ ID NO: 338. In some embodiments, the recombinant tyrosine ammonia lyase comprises at least one substitution in at least one position or set of positions selected from L116M, L116V, N130C, M133T, A136Q, Y158H, Y158I, Y158L, Y158Q, Y158S, Y158W, F162H, F162Y, L211V, A251S, F267Y, A280V, L319A, S343A, A356H, Q366E, Y367A, Y367C, Y367S, G369S, L386V, L390V, P403T, I428M, I439L, A440S, F443Y, P444A, A462S, T463E, T463F, T463G, T463L, T463M, T463N, N474C, N474E, N474F, N474G, N474H, N474R, N474S, N474T, A477S, I478A, I478L, I478V, A479G, A479S, M481L, I530L, I530V, and H541M, wherein the positions are numbered with reference to SEQ ID NO: 338.

In some additional embodiments, the recombinant tyrosine ammonia lyase comprises at least one substitution in at least one position or set of positions selected from 54, 54/116/119/364, 54/119/162/364/410, 54/364/403, 54/410/463, 54/462, 54/463, 54/530, 116/162/364, 119/162, 119/162/410, 410, 462, and 474, wherein the positions are numbered with reference to SEQ ID NO: 504. In some embodiments, the recombinant tyrosine ammonia lyase comprises at least one substitution in at least one position or set of positions selected from 54P, 54P/116V/119E/364M, 54P/119E/162Y/364M/410P, 54P/364M/403T, 54P/410P/463E, 54P/462S, 54P/463E, 54P/530V, 116V/162Y/364M, 119E/162Y, 119E/162Y/410P, 410P, 462S, and 474E, wherein the positions are numbered with reference to SEQ ID NO: 504. In some embodiments, the recombinant tyrosine ammonia lyase comprises at least one substitution in at least one position or set of positions selected from K54P, K54P/L116V/A119E/H364M, K54P/A119E/F162Y/H364M/S410P, K54P/H364M/P403T, K54P/S410P/T463E, K54P/A462S, K54P/T463E, K54P/I530V, L116V/F162Y/H364M, A119E/F162Y, A119E/F162Y/S410P, S410P, A462S, and N474E, wherein the positions are numbered with reference to SEQ ID NO: 504.

In some further embodiments, the recombinant tyrosine ammonia lyase comprises at least one substitution in at least one position or set of positions selected from 18, 18/52/463, 18/254, 18/267/554, 18/289, 18/289/339/364/554, 18/289/534/554, 18/289/554, 18/339/418/463, 18/339/463, 18/339/534, 254/289/339/418/463/554, 289/315/339/364/418/463/551, 289/534/554, 339/364/463, 534, and 534/551/554, wherein the positions are numbered with reference to SEQ ID NO: 736. In some embodiments, the recombinant tyrosine ammonia lyase comprises at least one substitution in at least one position or set of positions selected from 18H, 18H/52D/463T, 18H/254I, 18H/267Y/554Q, 18H/289Q, 18H/289Q/339T/364M/554Q, 18H/289Q/534D/554Q, 18H/289Q/554Q, 18H/339T/418M/463T, 18H/339T/463T, 18H/

339T/534D, 254I/289Q/339T/418M/463T/554Q, 289Q/ 315A/339T/364M/418M/463T/551Q, 289Q/534D/554Q, 339T/364M/463T, 534D, and 534D/551Q/554Q, wherein the positions are numbered with reference to SEQ ID NO: 736. In some embodiments, the recombinant tyrosine ammonia lyase comprises at least one substitution in at least one position or set of positions selected from F18H, F18H/ N52D/E463T, F18H/L254I, F18H/F267Y/V554Q, F18H/ A289Q, F18H/A289Q/I339T/H364M/V554Q, F18H/ A289Q/N534D/V554Q, F18H/A289Q/V554Q, F18H/ I339T/L418M/E463T, F18H/I339T/E463T, F18H/I339T/ N534D, L254I/A289Q/I339T/L418M/E463T/V554Q, A289Q/5315A/I339T/H364M/L418M/E463T/A551Q, A289Q/N534D/V554Q, I339T/H364M/E463T, N534D, and N534D/A551Q/V554Q, wherein the positions are numbered with reference to SEQ ID NO: 736.

In some embodiments, the recombinant tyrosine lyase variant comprises any variant provided in Tables 2-1, 3-1, 4-1, 5-1, 6-1, 6-2, 7-1, and/or 8-1. In some additional embodiments, the recombinant tyrosine lyase variant comprises at least about 80%, 85%, 90%, 91%, 92%, 93%, 94%, 95%, 96%, 97%, 98%, or 99% sequence identity to SEQ ID NO: 2. In some further embodiments, the recombinant tyrosine lyase variant comprises at least 90% sequence identity to at least one of the even numbered sequences in SEQ ID NOS: 4-780. In some further embodiments, the recombinant tyrosine lyase variant comprises a polypeptide sequence comprising one of the even-numbered sequences of SEQ ID NOS: 4-780. In some additional embodiments, the recombinant tyrosine ammonia lyase comprises a sequence that is at least 80%, 85%, 90%, 91%, 92%, 93%, 94%, 95%, 96%, 97%, 98%, or 99% identical to the polypeptide sequence of SEQ ID NO: 6, 28, 92, 308, 338, 504, and/or 736. In some additional embodiments, the recombinant tyrosine ammonia lyase comprises a sequence that is at least 80%, 85%, 90%, 91%, 92%, 93%, 94%, 95%, 96%, 97%, 98%, or 99% identical to the polypeptide sequence of SEQ ID NO: 6, 28, 92, 308, 338, 504, and/or 736. In some additional embodiments, the recombinant tyrosine ammonia lyase comprises a sequence that is at least 90% identical to the polypeptide sequence of SEQ ID NO: 6, 28, 92, 308, 338, 504, and/or 736. In some additional embodiments, the recombinant tyrosine ammonia lyase comprises a sequence that is at least 95%, identical to the polypeptide sequence of SEQ ID NO: 6, 28, 92, 308, 338, 504, and/or 736. In some additional embodiments, the recombinant tyrosine ammonia lyase comprises SEQ ID NO: 6, 28, 92, 308, 338, 504, and/or 736. In some further embodiments, the recombinant tyrosine ammonia lyase is thermostable. In still some additional embodiments, the recombinant tyrosine ammonia lyase is resistant to proteolysis. In some additional embodiments, the recombinant tyrosine ammonia lyase is resistant to at least one digestive tract protease. In some further embodiments, the digestive tract protease is selected from chymotrypsin, trypsin, carboxypeptidases, and elastases. In yet some additional embodiments, the recombinant tyrosine ammonia lyase is acid stable. In some further embodiments, the recombinant tyrosine ammonia lyase is a deimmunized tyrosine ammonia lyase. In still some additional embodiments, the recombinant tyrosine ammonia lyase is purified. In some embodiments, the recombinant tyrosine ammonia lyase exhibits at least one improved property selected from: i) enhanced catalytic activity; ii) reduced sensitivity to proteolysis; iii) increased tolerance to acidic pH; iv) reduced aggregation; v) decreased Km for tyrosine; vi) decreased immunogenicity; or a combination of any of i), ii), iii), iv), v), and/or vi), as compared to a reference sequence. In some embodiments, the reference sequence is selected from SEQ ID NO: 6, 28, 92, 308, 338, 504, and/or 736. The present invention also provides compositions comprising at least one recombinant tyrosine ammonia lyase provided herein.

The present invention also provides recombinant polynucleotide sequences encoding at least one recombinant tyrosine ammonia lyase provided herein. In some embodiments, the polynucleotide sequence is codon-optimized. In yet some additional embodiments, the polynucleotide comprises at least 90% sequence identity to at least one of the odd-numbered sequences of SEQ ID NOS: 3-779. In some further embodiments, the recombinant polynucleotide sequence comprises an odd-numbered sequence of SEQ ID NOS: 3-779. The present invention also provides expression vectors comprising at least one recombinant polynucleotide sequence provided herein. In some embodiments, the expression vector comprises a recombinant polynucleotide sequence provided herein. In some additional embodiments, the recombinant polynucleotide sequence is operably linked to a control sequence. In some further embodiments, the control sequence is a promoter. In some embodiments, the promoter is a heterologous promoter. The present invention also provides host cells comprising at least one expression vector provided herein. The present invention also provides host cells comprising an expression vector provided herein. In some embodiments, the host cell is prokaryotic, while in some other embodiments, the host cell is eukaryotic.

The present invention also provides methods of producing a tyrosine ammonia lyase variant, comprising culturing a host cell provided herein under conditions that the tyrosine ammonia lyase encoded by the recombinant polynucleotide is produced. In some embodiments, the methods further comprise the step of recovering the tyrosine ammonia lyase. In yet some additional embodiments, the method further comprises the step of purifying the tyrosine ammonia lyase.

The present invention also provides pharmaceutical compositions for the treatment of tyrosinemia, comprising at least one recombinant tyrosine ammonia lyase provided herein. In some embodiments, the pharmaceutical composition further comprises a pharmaceutically acceptable carrier and/or excipient. In some additional embodiments, the pharmaceutical composition is suitable for oral administration to a human. In some additional embodiments, the pharmaceutical composition is in the form of a pill, tablet, capsule, gelcap, liquid, or emulsion. In yet some additional embodiments, the pharmaceutical composition is coadministered with nitisinone. In some further embodiments, the pharmaceutical composition comprises nitisinone. In some embodiments, the pharmaceutical composition is suitable for parenteral injection into a human. In yet some additional embodiments, the pharmaceutical composition is coadministered with at least one phenylalanine ammonia lyase. In some further embodiments, the pharmaceutical composition comprises at least one phenylalanine ammonia lyase. In yet some additional embodiments, the pharmaceutical composition is coadministered with nitisinone and at least one phenylalanine ammonia lyase. In some further embodiments, the pharmaceutical composition comprises nitisinone and at least one phenylalanine ammonia lyase. In some embodiments, the pharmaceutical composition comprises a pill, tablet, capsule, or gelcap that further comprises an enteric coating.

The present invention provides methods for treating and/ or preventing the symptoms of tyrosinemia or alkaptonuria in a subject, comprising providing a subject having tyrosinemia or alkaptonuria, and providing at least one pharmaceutical composition provided herein to the subject. In some embodiments, the symptoms of tyrosinemia or alkaptonuria are ameliorated. In some additional embodiments, the subject is able to eat a diet that is less restricted in its phenylalanine and/or tyrosine content than diets required by subjects exhibiting the symptoms of tyrosinemia or alkaptonuria. In some further embodiments, the subject is an infant or child, while in some alternative embodiments, the subject is an adult or young adult.

The present invention also provides methods for the production of L-tyrosine and/or L-tyrosine derivatives comprising the steps of providing at least one recombinant TAL variant provided herein and a suitable substrate, and combining the TAL variant(s) and the substrate under conditions such that L-tyrosine and/or at least one L-tyrosine derivative is produced. The present invention also provides methods for the production of coumaric acid, comprising the steps of providing at least one recombinant TAL variant provided herein and a suitable substrate, and combining the TAL variant(s) and the substrate under conditions such that coumaric acid is produced. The present invention also provides means for use of the compositions provided herein. The present invention also provides means for use of the enzyme and pharmaceutical compositions provided herein.

DESCRIPTION OF THE INVENTION

The present invention provides engineered tyrosine ammonia-lyase (TAL) polypeptides and compositions thereof. In some embodiments, the engineered TAL polypeptides have been optimized to provide enhanced catalytic activity and enhanced acid stability, while reducing sensitivity to proteolysis. The invention also provides methods for utilization of the compositions comprising the engineered TAL polypeptides for therapeutic and industrial purposes.

Abbreviations and Definitions:

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

Also, as used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value. In some instances, "about" encompasses values that are within 2.5%, 3%, 3.5%, 4%, 4.5%, 5%, 5.5%, 6%, 6.5%, 7%, 7.5%, 8%, 8.5%, 9%, 9.5%, or 10% of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

As used herein, the terms "tyrosine ammonia-lyase" "tyrosine ammonia lyase," "tyrosine ammonia lyase polypeptide" and "TAL" refer to a class of enzymes within the aromatic amino acid lyase family (EC 4.3.1.23, EC 4.3.1.24 and EC4.3.1.25) which also includes histidine ammonia-lyase, and phenylalanine ammonia-lyase.

"Protein," "polypeptide," and "peptide" are used interchangeably herein to denote a polymer of at least two amino acids covalently linked by an amide bond, regardless of length or post-translational modification (e.g., glycosylation or phosphorylation).

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

The term "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

"Deimmunized" as used herein, refers to the manipulation of a protein to create a variant that is not as immunogenic as the wild-type or reference protein. In some embodiments, the deimmunization is complete, in that the variant protein does not stimulate an immune response in patients to whom the variant protein is administered. This response can be measured by various methods including but not limited to, the presence or abundance of anti-drug antibodies, the presence or abundance of neutralizing antibodies, the presence of an anaphylactic response, or the prevalence or intensity of cytokine release upon administration of the protein. In some embodiments, the variant protein is less immunogenic than the wild-type or reference protein. In some embodiments, deimmunization involves modifications to proteins (e.g., epitopes) that are recognized by T-cell receptors. In some embodiments, the T-cell epitopes are removed from a wild-type or reference protein in order to produce a deimmunized variant protein. In some embodiments, the deimmunized protein shows lower levels of response in biochemical and cell-biological predictors of human immunological responses including dendritic-cell T-cell activation assays, or human leukocyte antigen (HLA) peptide binding assays.

"Coding sequence" refers to that part of a nucleic acid (e.g., a gene) that encodes an amino acid sequence of a protein.

The term "percent (%) sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970], by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See, Altschul et al., J. Mol. Biol., 215: 403-410 [1990]; and Altschul et al., 1977, Nucleic Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered TAL, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X18 as compared to SEQ ID NO: 6" refers to a difference of the amino acid residue at the polypeptide position corresponding to position 18 of SEQ ID NO: 6. Thus, if the reference polypeptide of SEQ ID NO: 6 has a phenylalanine at position 18, then a "residue difference at position X18 as compared to SEQ ID NO: 6" an amino acid substitution of any residue other than phenylalanine at the position of the polypeptide corresponding to position 18 of SEQ ID NO: 6. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances, the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "l" (e.g., X18H/X18P or X18H/P). The present application includes engineered polypeptide sequences comprising one or more amino acid differences that include either/or both conservative and non-conservative amino acid substitutions.

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered transaminase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" or a "biologically active fragment" used interchangeably herein refers to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered TAL of the present invention) and that retains substantially all of the activity of the full-length polypeptide.

"Isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The recombinant TAL polypeptides may be present within a cell, present in the cellular medium, or prepared in various forms, such as lysates or isolated preparations. As such, in some embodiments, the recombinant TAL polypeptides can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure TAL composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant TAL polypeptides are substantially pure polypeptide compositions.

"Improved enzyme property" refers to an engineered TAL polypeptide that exhibits an improvement in any enzyme property as compared to a reference TAL polypeptide and/or as a wild-type PAL polypeptide (e.g., the wild-type AvPAL of SEQ ID NO: 2) or another engineered TAL polypeptide. Improved properties include but are not limited to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, reduced immunogenicity, and altered temperature profile.

"Increased enzymatic activity" or "enhanced catalytic activity" refers to an improved property of the engineered TAL polypeptides, which can be represented by an increase in specific activity (e.g., product produced/time/weight protein) or an increase in percent conversion of the substrate to the product (e.g., percent conversion of starting amount of substrate to product in a specified time period using a specified amount of TAL) as compared to the reference TAL enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring TAL or another engineered TAL from which the TAL polypeptides were derived.

In some embodiments, the engineered TAL polypeptides have a $k_{cat}$ of at least 0.1/sec, at least 0.2/sec, at least 0.3/sec, at least 0.5/sec, at least 1.0/sec and in some preferred embodiments greater than 1.0/sec. In some embodiments, the $K_m$ is in the range of about 1 µm to about 5 mM; in the range of about 5 µm to about 2 mM; in the range of about 10 nm to about 2 mM; or in the range of about 10 µm to about 1 mM. In some specific embodiments, the engineered TAL enzyme exhibits improved enzymatic activity in the range of 1.5 to 10 fold, 1.5 to 25 fold, 1.5 to 50 fold, 1.5 to 100 fold or greater than that of a reference TAL enzyme (e.g., a wild-type TAL or any other reference TAL). TAL activity can be measured by any suitable method known in the art (e.g., standard assays, such as monitoring changes in spectrophotometric properties of reactants or products). In some embodiments, the amount of products produced can be measured by High-Performance Liquid Chromatography (HPLC) separation combined with UV absorbance or fluorescent detection directly or following o-phthaldialdehyde (OPA) derivatization. In some embodiments, other methods are used, such as tracking the coumarate product (e.g., use UV absorbance to track its production at 290 nm or 310 nm). In some other embodiments, the production of ammonia is assayed using commercially available kits (e.g., the Megazyme rapid ammonia assay kit [Megazyme International, Wicklow, Ireland]). Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

The terms "thermally stable" and "thermostable" refer to enzymes of the present invention that retain a specified amount of enzymatic activity, primary, secondary, tertiary and quaternary structure after exposure to an identified temperatures over a given period of time under conditions prevailing during the use of the enzyme, for example, when exposed to altered temperatures. "Altered temperatures" include increased or decreased temperatures. In some embodiments, the enzymes retain at least about 50%, about 60%, about 70%, about 75%, about 80%, about 85%, about 90%, about 92%, about 95%, about 96%, about 97%, about 98%, or about 99% enzymatic activity after exposure to altered temperatures over a given time period, for example, at least about 60 minutes, about 120 minutes, about 180 minutes, about 240 minutes, about 300 minutes, etc.

The term "improved tolerance to acidic pH" means that a recombinant TAL according to the invention will have increased stability (higher retained activity at about pH 7.0 after exposure to acidic pH for a specified period of time (1 hour, up to 24 hours)) as compared to a reference TAL or another enzyme.

"Physiological pH" as used herein means the pH range generally found in a subject's (e.g., human) small intestine. There normally is a pH gradient from the pyloric sphincter to the large intestine from about 5.0 to 7.5.

The term "acidic pH" (e.g., used with reference to improved stability to acidic pH conditions or increased tolerance to acidic pH) means a pH range of about 1.5 to 6.8.

The terms "proteolytic activity" and "proteolysis" used interchangeably herein refer to the breakdown of proteins into smaller polypeptides or amino acids. The breakdown of proteins is generally the result of hydrolysis of the peptide bond by protease (proteinase) enzymes. Protease enzymes include but are not limited to pepsin, trypsin, chymotrypsin, elastase, carboxypeptidase A and B, peptidases (e.g., amino peptidase, dipeptidase and enteropeptidase).

The phrases "reducing sensitivity to proteolysis" and "reducing proteolytic sensitivity" used interchangeably herein mean that an engineered TAL polypeptide according to the invention will have a higher enzyme activity compared to a reference TAL and/or another enzyme in a standard assay after treatment with one or more proteases. Exemplary assays are provided in the Examples.

"Aggregation" means clumping or precipitation of a TAL polypeptide. Aggregation can lead to inactivation, and/or increased immunogenicity of the enzyme. The term "reduced aggregation" means an engineered TAL polypeptide will be less prone to aggregation or to aggregate than a reference TAL and/or another enzyme. Methods for determining Aggregation can be determined by one of general skill in the art by using any number of assays including but not limited to fluorescent microscopy with appropriate dyes (e.g., thioflavin T or Nile Red), dynamic light scattering, flow cytometry with appropriate dyes (e.g. Bodipy), filtration and analysis by SDS-PAGE or Western blotting, fluorescent correlation spectroscopy, and electron microscopy. There are commercially available kits to assess aggregation (e.g., the ProteoStat® Protein Aggregation Assay kit [Enzo]).

"Conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a TAL polypeptide can be expressed as "percent conversion" of the substrate to the product in a specific period of time.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is more efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the TAL enzymes may be codon optimized for optimal production from the host organism selected for expression.

"Control sequence" refers herein to include all components, which are necessary or advantageous for the expression of a polynucleotide and/or polypeptide of the present application. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refers to those conditions in the enzymatic conversion reaction solution (e.g., ranges of enzyme loading, substrate loading, temperature, pH, buffers, co-solvents, etc.) under which a TAL polypeptide of the present application is capable of converting a substrate to the desired product compound, Exemplary "suitable reaction conditions" are provided in the present application and illustrated by the Examples. "Loading", such as in "compound loading" or "enzyme loading" refers to the concentration or amount of a component in a reaction mixture at the start of the reaction. "Substrate" in the context of an enzymatic conversion reaction process refers to the compound or molecule acted on by the TAL polypeptide. "Product" in the context of an enzymatic conversion process refers to the compound or molecule resulting from the action of the TAL polypeptide on a substrate.

As used herein the term "culturing" refers to the growing of a population of microbial cells under any suitable conditions (e.g., using a liquid, gel or solid medium).

Recombinant polypeptides can be produced using any suitable methods known the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant TAL polypeptides" (also referred to herein as "engineered TAL polypeptides," "variant TAL enzymes," and "TAL variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., the polynucleotides encoding the TAL variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

The term "therapeutic" refers to a compound administered to a subject who shows signs or symptoms of pathology having beneficial or desirable medical effects.

The term "pharmaceutical composition" refers to a composition suitable for pharmaceutical use in a mammalian subject (e.g., human) comprising a pharmaceutically effective amount of an engineered TAL polypeptide encompassed by the invention and an acceptable carrier.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

The term "subject" encompasses mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

The term "infant" refers to a child in the period of the first month after birth to approximately one (1) year of age. As used herein, the term "newborn" refers to child in the period from birth to the $28^{th}$ day of life. The term "premature infant" refers to an infant born after the twentieth completed week of gestation, yet before full term, generally weighing ~500 to ~2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered TAL of the present invention, intended for any suitable use (e.g., pharmaceutical compositions, dietary/nutritional supplements, feed, etc.).

The terms "administration" and "administering" a composition mean providing a composition of the present invention to a subject (e.g., to a person suffering from the effects of tyrosinemia or alkaptonuria).

The term "carrier" when used in reference to a pharmaceutical composition means any of the standard pharmaceutical carrier, buffers, and excipients, such as stabilizers, preservatives, and adjuvants.

The term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered TAL polypeptides of the present invention). Excipients are typically included for formulation and/or administration purposes.

The term "therapeutically effective amount" when used in reference to symptoms of disease/condition refers to the amount and/or concentration of a compound (e.g., engineered TAL polypeptides) that ameliorates, attenuates, or eliminates one or more symptom of a disease/condition or prevents or delays the onset of symptom(s).

The term "therapeutically effective amount" when used in reference to a disease/condition refers to the amount and/or concentration of a composition (e.g., engineered TAL polypeptides) that ameliorates, attenuates, or eliminates the disease/condition. In some embodiments, the term is use in reference to the amount of a composition that elicits the biological (e.g., medical) response by a tissue, system, or animal subject that is sought by the researcher, physician, veterinarian, or other clinician.

It is intended that the terms "treating," "treat" and "treatment" encompass preventative (e.g., prophylactic), as well as palliative treatment.

Engineered TAL Polypeptides:

The parent enzyme used to generate the engineered TAL polypeptides is a PAL obtained from *Anabaena variabilis*. In some embodiments, alternative enzymes find use as parent enzymes to generate engineered TAL polypeptides (e.g., *Nostoc punctiforme* phenylalanine/histidine ammonia lyase "NpPHAL" (NCBI YP_001865631.1; *Rivularia* sp. histidine ammonia-lyase "RspHAL" (NCBI YP_007056096.1; *Oscillatoria* sp. histidine ammonia-lyase "Osp HAL" (NCBI YP_07108482.1; and *Gloeocapsa* sp. histidine ammonia-lyase "GspHAL" (NCBI YP_007127054.1). Furthermore, when a particular TAL variant (engineered TAL polypeptide) is referred to by reference to modification of particular amino acids residues in the sequence of a wild-type TAL, wild-type PAL, wild-type HAL or another TAL, it is to be understood that variants of another TAL modified in the equivalent position(s) (as determined from the optional amino acid sequence alignment between the respective amino acid sequences) are encompassed herein. In some embodiments the engineered TAL polypeptide will comprise the conserved active site Ala167-Ser168-Gly169 and comprise at least 70% (at least 75%, at least 80%, at least 85%, at least 90%, at least 93%, at least 95%, at least 97%) sequence identity to SEQ ID NO: 2. In some embodiments the engineered TAL polypeptides comprise not only TAL activity but also may be active on phenylalanine and/or histidine substrates. In some embodiments, TAL variants are developed that comprise at least one mutation in at least one key residue (e.g., position 107; See e.g., WO 2008/069958; U.S. Appln. Ser. No. 2009/011140; and Watts et al. Chem. Biol., 13:1317-26 [2006]).

In some embodiments, engineered TAL polypeptides are produced by cultivating a microorganism comprising at least one polynucleotide sequence encoding at least one engineered TAL polypeptide under conditions which are conducive for producing the engineered TAL polypeptide(s). In some embodiments, the engineered TAL polypeptide is recovered from the resulting culture medium and/or cells.

The present invention provides exemplary engineered TAL polypeptides having TAL activity. The Examples provide Tables showing sequence structural information correlating specific amino acid sequence features with the functional activity of the engineered TAL polypeptides. This structure-function correlation information is provided in the form of specific amino acid residues differences relative to a reference engineered polypeptide, as indicated in the Examples. The Examples further provide experimentally determined activity data for the exemplary engineered TAL polypeptides.

In some embodiments, the engineered TAL polypeptides of the invention having TAL activity comprise a) an amino acid sequence having at least 85% sequence identity to reference sequence SEQ ID NO: 2; b) an amino acid residue difference as compared to SEQ ID NO: 2 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 2 and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 2, and an amino acid residue difference as compared to SEQ ID NO: 2, at one or more amino acid positions (e.g., at 1, 2, 3, 4, 5, 6, 7, 8, 9, 10, 11, 12, 14, 15, 20 or more amino acid positions compared to SEQ ID NO: 2, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2). In some embodiment the residue difference as compared to SEQ ID NO: 2, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 2.

In some embodiments, the engineered TAL polypeptides of the invention having TAL activity comprise a) an amino acid sequence having at least 85% sequence identity to reference sequence SEQ ID NO: 4; b) an amino acid residue difference as compared to SEQ ID NO: 4 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 4 and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 4, and an amino acid residue difference as compared to SEQ ID NO: 4, at one or more amino acid positions (e.g., at 1, 2, 3, 4, 5, 6, 7, 8, 9, 10, 11, 12, 14, 15, 20 or more amino acid positions compared to SEQ ID NO: 4, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 4). In some embodiment the residue difference as compared to SEQ ID NO: 4, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 4. In some embodiments, the engineered TAL polypeptide is a polypeptide listed in Table 2-1, 3-1, 4-1, 5-1, 6-1, 6-2, 7-1, and/or 8-1.

In some embodiments, the engineered TAL polypeptides of the invention having TAL activity comprise a) an amino acid sequence having at least 85% sequence identity to reference sequence SEQ ID NO: 6; b) an amino acid residue difference as compared to SEQ ID NO: 6 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 4 and/or another reference sequence. In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 6, and an amino acid residue difference as compared to SEQ ID NO: 6, at one or more amino acid positions (e.g., at 1, 2, 3, 4, 5, 6, 7, 8, 9, 10, 11, 12, 14, 15, 20 or more amino acid positions compared to SEQ ID NO: 6, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6). In some embodiment the residue difference as compared to SEQ ID NO: 6, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 6.

In some embodiments, the engineered TAL polypeptides of the invention having TAL activity comprise a) an amino acid sequence having at least 85% sequence identity to reference sequence SEQ ID NO: 6; b) an amino acid residue difference as compared to SEQ ID NO: 6 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 6 and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 6, and an amino acid residue difference as compared to SEQ ID NO: 6, at one or more amino acid positions (e.g., at 1, 2, 3, 4, 5, 6, 7, 8, 9, 10, 11, 12, 14, 15, 20 or more amino acid positions compared to SEQ ID NO: 6, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6). In some embodiment the residue difference as compared to SEQ ID NO: 6, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 6.

In some embodiments, the engineered TAL polypeptides of the invention having TAL activity comprise a) an amino acid sequence having at least 85% sequence identity to reference sequence SEQ ID NO: 28; b) an amino acid residue difference as compared to SEQ ID NO: 28 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 28 and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 28, and an amino acid residue difference as compared to SEQ ID NO: 28, at one or more amino acid positions (e.g., at 1, 2, 3, 4, 5, 6, 7, 8, 9, 10, 11, 12, 14, 15, 20 or more amino acid positions compared to SEQ ID NO: 28, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 28). In some embodiment the residue difference as compared to SEQ ID NO: 28, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 28.

In some embodiments, the engineered TAL polypeptides of the invention having TAL activity comprise a) an amino acid sequence having at least 85% sequence identity to reference sequence SEQ ID NO: 92; b) an amino acid residue difference as compared to SEQ ID NO: 92 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 92 and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 92, and an amino acid residue difference as compared to SEQ ID NO: 92, at one or more amino acid positions (e.g., at 1, 2, 3, 4, 5, 6, 7, 8, 9, 10, 11, 12, 14, 15, 20 or more amino acid positions compared to SEQ ID NO: 92, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 92). In some embodiment the residue difference as compared to SEQ ID NO: 92, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 92.

In some embodiments, the engineered TAL polypeptides of the invention having TAL activity comprise a) an amino acid sequence having at least 85% sequence identity to reference sequence SEQ ID NO: 308; b) an amino acid residue difference as compared to SEQ ID NO: 308 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 308 and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 308, and an amino acid residue difference as compared to SEQ ID NO: 308, at one or more amino acid positions (e.g., at 1, 2, 3, 4, 5, 6, 7, 8, 9, 10, 11, 12, 14, 15, 20 or more amino acid positions compared to SEQ ID NO: 308, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 308). In some embodiment the residue difference as compared to SEQ ID NO: 308, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 308.

In some embodiments, the engineered TAL polypeptides of the invention having TAL activity comprise a) an amino acid sequence having at least 85% sequence identity to reference sequence SEQ ID NO: 338; b) an amino acid residue difference as compared to SEQ ID NO: 338 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 338 and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 338, and an amino acid residue difference as compared to SEQ ID NO: 338, at one or more amino acid positions (e.g., at 1, 2, 3, 4, 5, 6, 7, 8, 9, 10, 11, 12, 14, 15, 20 or more amino acid positions compared to SEQ ID NO: 338, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 338). In some embodiment the residue difference as compared to SEQ ID NO: 338, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 338.

In some embodiments, the engineered TAL polypeptides of the invention having TAL activity comprise a) an amino acid sequence having at least 85% sequence identity to reference sequence SEQ ID NO: 504; b) an amino acid residue difference as compared to SEQ ID NO: 504 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 504 and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 504, and an amino acid residue difference as compared to SEQ ID NO: 504, at one or more amino acid positions (e.g., at 1, 2, 3, 4, 5, 6, 7, 8, 9, 10, 11, 12, 14, 15, 20 or more amino acid positions compared to SEQ ID NO: 504, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 504). In some embodiment the residue difference as compared to SEQ ID NO: 504, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 504.

In some embodiments, the engineered TAL polypeptides of the invention having TAL activity comprise a) an amino acid sequence having at least 85% sequence identity to reference sequence SEQ ID NO: 736; b) an amino acid residue difference as compared to SEQ ID NO: 736 at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 736 and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 736, and an amino acid residue difference as compared to SEQ ID NO: 736, at one or more amino acid positions (e.g., at 1, 2, 3, 4, 5, 6, 7, 8, 9, 10, 11, 12, 14, 15, 20 or more amino acid positions compared to SEQ ID NO: 736, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 736). In some embodiment the residue difference as compared to SEQ ID NO: 736, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 736.

In some embodiments, the engineered TAL polypeptide comprises a functional fragment of an engineered TAL polypeptide encompassed by the invention. Functional fragments have at least 95%, 96%, 97%, 98%, or 99% of the activity of the engineered TAL polypeptide from which is was derived (i.e., the parent engineered TAL). A functional fragment comprises at least 90%, 91%, 92%, 93%, 94%, 95%, 96%, 97%, 98% and even 99% of the parent sequence of the engineered TAL. In some embodiments the functional fragment is truncated by less than 5, less than 10, less than 15, less than 10, less than 25, less than 30, less than 35, less than 40, less than 45, and less than 50 amino acids.

Variants with Reduced Sensitivity to Proteolysis:

In some embodiments, the engineered TAL polypeptides of the invention having TAL activity comprise a) an amino acid sequence having at least 85% sequence identity to reference sequence SEQ ID NO: 2; b) an amino acid residue difference as compared to SEQ ID NO: 2 at one or more amino acid positions; and c) which exhibits reduced sensitivity to proteolysis as compared to SEQ ID NO: 2 and/or another reference sequence.

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2 and an amino acid residue difference as compared to SEQ ID NO: 2 at one or more amino acid positions (e.g., at 1, 2, 3, 4, 5, 6, 7, 8, 9, 10, 11, 12, 14, 15, 20 or more amino acid positions compared to SEQ ID NO: 2 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2).

In some embodiments, the engineered TAL polypeptides of the invention having TAL activity comprise a) an amino acid sequence having at least 85% sequence identity to reference sequence SEQ ID NO: 4; b) an amino acid residue difference as compared to SEQ ID NO: 4 at one or more amino acid positions; and c) which exhibits reduced sensitivity to proteolysis as compared to SEQ ID NO: 4 and/or another reference sequence.

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 4 and an amino acid residue difference as compared to SEQ ID NO: 4 at one or more amino acid positions (e.g., at 1, 2, 3, 4, 5, 6, 7, 8, 9, 10, 11, 12, 14, 15, 20 or more amino acid positions compared to SEQ ID NO: 4 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 4).

In some embodiments, the engineered TAL polypeptides of the invention having TAL activity comprise a) an amino acid sequence having at least 85% sequence identity to reference sequence SEQ ID NO: 6; b) an amino acid residue difference as compared to SEQ ID NO: 6 at one or more amino acid positions; and c) which exhibits reduced sensitivity to proteolysis, as compared with SEQ ID NO: 4 and/or another reference sequence. In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6 and an amino acid residue difference as compared to SEQ ID NO: 6 at one or more amino acid positions (e.g., at 1, 2, 3, 4, 5, 6, 7, 8, 9, 10, 11, 12, 14, 15, 20 or more amino acid positions compared to SEQ ID NO: 6 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6).

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6 and an amino acid residue difference as compared to SEQ ID NO: 6 at one or more amino acid positions (e.g., at 1, 2, 3, 4, 5, 6, 7, 8, 9, 10, 11, 12, 14, 15, 20 or more amino acid positions compared to SEQ ID NO: 6 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6).

In some embodiments, the engineered TAL polypeptides of the invention having TAL activity comprise a) an amino acid sequence having at least 85% sequence identity to reference sequence SEQ ID NO: 28; b) an amino acid residue difference as compared to SEQ ID NO: 28 at one or more amino acid positions; and c) which exhibits reduced sensitivity to proteolysis as compared to SEQ ID NO: 28 and/or another reference sequence.

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 28 and an amino acid residue difference as compared to SEQ ID NO: 28 at one or more amino acid positions (e.g., at 1, 2, 3, 4, 5, 6, 7, 8, 9, 10, 11, 12, 14, 15, 20 or more amino acid positions compared to SEQ ID NO: 28 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 28).

In some embodiments, the engineered TAL polypeptides of the invention having TAL activity comprise a) an amino acid sequence having at least 85% sequence identity to reference sequence SEQ ID NO: 92; b) an amino acid residue difference as compared to SEQ ID NO: 92 at one or more amino acid positions; and c) which exhibits reduced sensitivity to proteolysis as compared to SEQ ID NO: 92 and/or another reference sequence.

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 92 and an amino acid residue difference as compared to SEQ ID NO: 92 at one or more amino acid positions (e.g., at 1, 2, 3, 4, 5, 6, 7, 8, 9, 10, 11, 12, 14, 15, 20 or more amino acid positions compared to SEQ ID NO: 92 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 92).

In some embodiments, the engineered TAL polypeptides of the invention having TAL activity comprise a) an amino acid sequence having at least 85% sequence identity to reference sequence SEQ ID NO: 308; b) an amino acid residue difference as compared to SEQ ID NO: 308 at one or more amino acid positions; and c) which exhibits reduced sensitivity to proteolysis as compared to SEQ ID NO: 308 and/or another reference sequence.

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 308 and an amino acid residue difference as compared to SEQ ID NO: 308 at one or more amino acid positions (e.g., at 1, 2, 3, 4, 5, 6, 7, 8, 9, 10, 11, 12, 14, 15, 20 or more amino acid positions compared to SEQ ID NO: 308 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 308).

In some embodiments, the engineered TAL polypeptides of the invention having TAL activity comprise a) an amino acid sequence having at least 85% sequence identity to reference sequence SEQ ID NO: 338; b) an amino acid residue difference as compared to SEQ ID NO: 338 at one or more amino acid positions; and c) which exhibits reduced sensitivity to proteolysis as compared to SEQ ID NO: 338 and/or another reference sequence.

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 338 and an amino acid residue difference as compared to SEQ ID NO: 338 at one or more amino acid positions (e.g., at 1, 2, 3, 4, 5, 6, 7, 8, 9, 10, 11, 12, 14, 15, 20 or more amino acid positions compared to SEQ ID NO: 338 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 338).

In some embodiments, the engineered TAL polypeptides of the invention having TAL activity comprise a) an amino acid sequence having at least 85% sequence identity to reference sequence SEQ ID NO: 504; b) an amino acid residue difference as compared to SEQ ID NO: 504 at one or more amino acid positions; and c) which exhibits reduced sensitivity to proteolysis as compared to SEQ ID NO: 504 and/or another reference sequence.

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 504 and an amino acid residue difference as compared to SEQ ID NO: 504 at one or more amino acid positions (e.g., at 1, 2, 3, 4, 5, 6, 7, 8, 9, 10, 11, 12, 14, 15, 20 or more amino acid positions compared to SEQ ID NO: 504 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 504).

In some embodiments, the engineered TAL polypeptides of the invention having TAL activity comprise a) an amino acid sequence having at least 85% sequence identity to reference sequence SEQ ID NO: 736; b) an amino acid residue difference as compared to SEQ ID NO: 736 at one or more amino acid positions; and c) which exhibits reduced sensitivity to proteolysis as compared to SEQ ID NO: 736 and/or another reference sequence.

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 736 and an amino acid residue difference as compared to SEQ ID NO: 736 at one or more amino acid positions (e.g., at 1, 2, 3, 4, 5, 6, 7, 8, 9, 10, 11, 12, 14, 15, 20 or more amino acid positions compared to SEQ ID NO: 736 or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 736).

In some embodiments, the proteolytic sensitivity of the engineered TAL polypeptide will be reduced by at least 5%, at least 10%, at least 15%, at least 20%, at least 25%, at least 30%, at least 40%, at least 50%, at least 60%, at least 70%, at least 80% and at least 85% compared to the wild-type AvPAL and/or at least one reference TAL polypeptide under essentially the same conditions. The proteolytic sensitivity can be measured using any suitable assay system, including, but not limited to the assays described in the Examples.

In some embodiments, the engineered TAL polypeptide having reduced sensitivity to proteolysis has reduced sensitivity to a composition comprising one or more proteases such as but not limited to pepsin, trypsin, chymotrypsin, carboxypeptidase A and B, peptidases (e.g., amino peptidase, dipeptidase and enteropeptidase) when both the reference TAL and the engineered TAL having the reduced sensitivity are compared and exposed to essentially the same amount and kind of protease under essentially the same conditions.

In some embodiments, the engineered TAL polypeptide having reduced sensitivity to proteolysis has enzyme activity that is about 1.0 fold, 2-fold, 5-fold, 10-fold, 20-fold, 25-fold, 50-fold, 75-fold, 100-fold, 150-fold, 200-fold or more of the enzymatic activity of the reference TAL. In some embodiments, the engineered polypeptides will have more enzyme activity (as compared to a reference TAL) when activity is measured at a pH range of 4.5 to 7.5; when activity is measured at a pH range of 4.5 to 6.5; when activity is measured at a pH range of 5.0 to 7.5, when activity is measured at a pH range of 5.0 to 6.5; when activity is measured at a pH range of 5.5 to 7.5 and also when activity is measured at a pH range of 5.5 to 6.5. In other embodiments, the engineered TAL polypeptides will have a $K_m$ in the range of 1 µM to 5 mM.

Variants with Increased Tolerance to Acidic pH:

In some embodiments, the engineered TAL polypeptides of the invention having TAL activity comprise a) an amino acid sequence having at least 85% sequence identity to reference sequence SEQ ID NO: 2, or a fragment thereof; b) an amino acid residue difference as compared to SEQ ID NO: 2, at one or more amino acid positions; and c) which exhibits increased tolerance to acidic pH as compared to SEQ ID NO: 2 and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2 and an amino acid residue difference as compared to SEQ ID NO: 2, at one or more amino acid positions (e.g., at 1, 2, 3, 4, 5, 6, 7, 8, 9, 10, 11, 12, 14, 15, 20 or more amino acid positions compared to SEQ ID NO: 2, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2.

In some embodiments, the engineered TAL polypeptides of the invention having TAL activity comprise a) an amino acid sequence having at least 85% sequence identity to reference sequence SEQ ID NO: 4, or a fragment thereof; b) an amino acid residue difference as compared to SEQ ID NO: 4, at one or more amino acid positions; and c) which exhibits increased tolerance to acidic pH as compared to SEQ ID NO: 4 and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 4 and an amino acid residue difference as compared to SEQ ID NO: 4, at one or more amino acid positions (e.g., at 1, 2, 3, 4, 5, 6, 7, 8, 9, 10, 11, 12, 14, 15, 20 or more amino acid positions compared to SEQ ID NO: 4, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 4.

In some embodiments, the engineered TAL polypeptides of the invention having TAL activity comprise a) an amino acid sequence having at least 85% sequence identity to reference sequence SEQ ID NO: 6, or a fragment thereof; b) an amino acid residue difference as compared to SEQ ID NO: 6, at one or more amino acid positions; and c) which exhibits increased tolerance to acidic pH, as compared to SEQ ID NO: 4. In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6, and an amino acid residue difference as compared to SEQ ID NO: 6, at one or more amino acid positions (e.g., at 1, 2, 3, 4, 5, 6, 7, 8, 9, 10, 11, 12, 14, 15, 20 or more amino acid positions compared to SEQ ID NO: 6, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6.

In some embodiments, the engineered TAL polypeptides of the invention having TAL activity comprise a) an amino acid sequence having at least 85% sequence identity to reference sequence SEQ ID NO: 6, or a fragment thereof; b) an amino acid residue difference as compared to SEQ ID NO: 6, at one or more amino acid positions; and c) which exhibits increased tolerance to acidic pH as compared to SEQ ID NO: 6 and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6 and an amino acid residue difference as compared to SEQ ID NO: 6, at one or more amino acid positions (e.g., at 1, 2, 3, 4, 5, 6, 7, 8, 9, 10, 11, 12, 14, 15, 20 or more amino acid positions compared to SEQ ID NO: 6, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6.

In some embodiments, the engineered TAL polypeptides of the invention having TAL activity comprise a) an amino acid sequence having at least 85% sequence identity to reference sequence SEQ ID NO: 28, or a fragment thereof; b) an amino acid residue difference as compared to SEQ ID NO: 28, at one or more amino acid positions; and c) which exhibits increased tolerance to acidic pH as compared to SEQ ID NO: 28 and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 28 and an amino acid residue difference as compared to SEQ ID NO: 28, at one or more amino acid positions (e.g., at 1, 2, 3, 4, 5, 6, 7, 8, 9, 10, 11, 12, 14, 15, 20 or more amino acid positions compared to SEQ ID NO: 28, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 28.

In some embodiments, the engineered TAL polypeptides of the invention having TAL activity comprise a) an amino acid sequence having at least 85% sequence identity to reference sequence SEQ ID NO: 92, or a fragment thereof; b) an amino acid residue difference as compared to SEQ ID NO: 92, at one or more amino acid positions; and c) which exhibits increased tolerance to acidic pH as compared to SEQ ID NO: 92 and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 92 and an amino acid residue difference as compared to SEQ ID NO: 92, at one or more amino acid positions (e.g., at 1, 2, 3, 4, 5, 6, 7, 8, 9, 10, 11, 12, 14, 15, 20 or more amino acid positions compared to SEQ ID NO: 92, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 92.

In some embodiments, the engineered TAL polypeptides of the invention having TAL activity comprise a) an amino acid sequence having at least 85% sequence identity to reference sequence SEQ ID NO: 308, or a fragment thereof; b) an amino acid residue difference as compared to SEQ ID NO: 308, at one or more amino acid positions; and c) which exhibits increased tolerance to acidic pH as compared to SEQ ID NO: 308 and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 308 and an amino acid residue difference as compared to SEQ ID NO: 308, at one or more amino acid positions (e.g., at 1, 2, 3, 4, 5, 6, 7, 8, 9, 10, 11, 12, 14, 15, 20 or more amino acid positions compared to SEQ ID NO: 308, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 308.

In some embodiments, the engineered TAL polypeptides of the invention having TAL activity comprise a) an amino acid sequence having at least 85% sequence identity to reference sequence SEQ ID NO: 338, or a fragment thereof; b) an amino acid residue difference as compared to SEQ ID NO: 338, at one or more amino acid positions; and c) which exhibits increased tolerance to acidic pH as compared to SEQ ID NO: 338 and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 338 and an amino acid residue difference as compared to SEQ ID NO: 338, at one or more amino acid positions (e.g., at 1, 2, 3, 4, 5, 6, 7, 8, 9, 10, 11, 12, 14, 15, 20 or more amino acid positions compared to SEQ ID NO: 338, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 338.

In some embodiments, the engineered TAL polypeptides of the invention having TAL activity comprise a) an amino acid sequence having at least 85% sequence identity to reference sequence SEQ ID NO: 504, or a fragment thereof; b) an amino acid residue difference as compared to SEQ ID NO: 504, at one or more amino acid positions; and c) which exhibits increased tolerance to acidic pH as compared to SEQ ID NO: 504 and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 504 and an amino acid residue difference as compared to SEQ ID NO: 504, at one or more amino acid positions (e.g., at 1, 2, 3, 4, 5, 6, 7, 8, 9, 10, 11, 12, 14, 15, 20 or more amino acid positions compared to SEQ ID NO: 504, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 504.

In some embodiments, the engineered TAL polypeptides of the invention having TAL activity comprise a) an amino acid sequence having at least 85% sequence identity to reference sequence SEQ ID NO: 736, or a fragment thereof; b) an amino acid residue difference as compared to SEQ ID NO: 736, at one or more amino acid positions; and c) which exhibits increased tolerance to acidic pH as compared to SEQ ID NO: 736 and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 736 and an amino acid residue difference as compared to SEQ ID NO: 736, at one or more amino acid positions (e.g., at 1, 2, 3, 4, 5, 6, 7, 8, 9, 10, 11, 12, 14, 15, 20 or more amino acid positions compared to SEQ ID NO: 736, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 736.

In some embodiments, when all other assay conditions are essentially the same, the engineered TAL polypeptide has increased tolerance to acidic pH as compared to a reference TAL polypeptide. The engineered peptide has an increased tolerance at a pH range between 1.5 to 6.5, and between 1.5 and 5.0, and between 2.0 to 5.5, and between 3.0 and 6.8; between 3.0 and 5.5; between 4.0 and 6.5; between 4.0 and 4.5; between 4.5 and between 5.0; between 4.5 and 5.5, between 4.5 and 6.0; between 4.5 and 6.5; between 5.0 and 6.5; between 5.0 and 6.0; between 5.0 and 5.5; between 5.5 and 6.0; between 6.0 and 6.5 and between 6.5 and 7.0. In some embodiments the increased tolerance to acidic pH will be exhibited at a pH of about 3.5, 4.0, 4.5, 5.0, 5.5, 6.0 and 6.5.

In some embodiments, the engineered TAL polypeptide having increased tolerance to acidic pH exhibits greater TAL activity as compared to a reference TAL when measured by any standard assay, including, but not limited to the assays described in the Examples.

Variants with Improved Activity:

In some embodiments, the engineered TAL polypeptides of the invention having TAL activity comprise a) an amino acid sequence having at least 85% sequence identity to reference sequence SEQ ID NO: 2, or a fragment thereof; b) an amino acid residue difference as compared to SEQ ID NO: 2, at one or more amino acid positions; and c) which exhibits improved activity, as compared to SEQ ID NO: 2 and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2 and an amino acid residue difference as compared to SEQ ID NO: 2, at one or more amino acid positions (e.g., at 1, 2, 3, 4, 5, 6, 7, 8, 9, 10, 11, 12, 14, 15, 20 or more amino acid positions compared to SEQ ID NO: 2, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2.

In some embodiments, the engineered TAL polypeptides of the invention having TAL activity comprise a) an amino acid sequence having at least 85% sequence identity to reference sequence SEQ ID NO: 4, or a fragment thereof; b) an amino acid residue difference as compared to SEQ ID NO: 4, at one or more amino acid positions; and c) which exhibits improved activity, as compared to SEQ ID NO: 4 and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 4 and an amino acid residue difference as compared to SEQ ID NO: 4, at one or more amino acid positions (e.g., at 1, 2, 3, 4, 5, 6, 7, 8, 9, 10, 11, 12, 14, 15, 20 or more amino acid positions compared to SEQ ID NO: 4, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 4.

In some embodiments, the engineered TAL polypeptides of the invention having TAL activity comprise a) an amino acid sequence having at least 85% sequence identity to reference sequence SEQ ID NO: 6, or a fragment thereof; b) an amino acid residue difference as compared to SEQ ID NO: 6, at one or more amino acid positions; and c) which exhibits improved activity, as compared to SEQ ID NO: 4. In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6 and an amino acid residue difference as compared to SEQ ID NO: 6, at one or more amino acid positions (e.g., at 1, 2, 3, 4, 5, 6, 7, 8, 9, 10, 11, 12, 14, 15, 20 or more amino acid positions compared to SEQ ID NO: 6, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6.

In some embodiments, the engineered TAL polypeptides of the invention having TAL activity comprise a) an amino acid sequence having at least 85% sequence identity to reference sequence SEQ ID NO: 6, or a fragment thereof; b) an amino acid residue difference as compared to SEQ ID NO: 6, at one or more amino acid positions; and c) which exhibits improved activity, as compared to SEQ ID NO: 6 and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6 and an amino acid residue difference as compared to SEQ ID NO: 6, at one or more amino acid positions (e.g., at 1, 2, 3, 4, 5, 6, 7, 8, 9, 10, 11, 12, 14, 15, 20 or more amino acid positions compared to SEQ ID NO: 6, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 6.

In some embodiments, the engineered TAL polypeptides of the invention having TAL activity comprise a) an amino acid sequence having at least 85% sequence identity to reference sequence SEQ ID NO: 28, or a fragment thereof; b) an amino acid residue difference as compared to SEQ ID NO: 28, at one or more amino acid positions; and c) which exhibits improved activity, as compared to SEQ ID NO: 28 and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 28 and an amino acid residue difference as compared to SEQ ID NO: 28, at one or more amino acid positions (e.g., at 1, 2, 3, 4, 5, 6, 7, 8, 9, 10, 11, 12, 14, 15, 20 or more amino acid positions compared to SEQ ID NO: 28, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 28.

In some embodiments, the engineered TAL polypeptides of the invention having TAL activity comprise a) an amino acid sequence having at least 85% sequence identity to reference sequence SEQ ID NO: 92, or a fragment thereof; b) an amino acid residue difference as compared to SEQ ID NO: 92, at one or more amino acid positions; and c) which exhibits improved activity, as compared to SEQ ID NO: 92 and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 92 and an amino acid residue difference as compared to SEQ ID NO: 92, at one or more amino acid positions (e.g., at 1, 2, 3, 4, 5, 6, 7, 8, 9, 10, 11, 12, 14, 15, 20 or more amino acid positions compared to SEQ ID NO: 92, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 92.

In some embodiments, the engineered TAL polypeptides of the invention having TAL activity comprise a) an amino acid sequence having at least 85% sequence identity to reference sequence SEQ ID NO: 308, or a fragment thereof; b) an amino acid residue difference as compared to SEQ ID NO: 308, at one or more amino acid positions; and c) which exhibits improved activity, as compared to SEQ ID NO: 308 and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 308 and an amino acid residue difference as compared to SEQ ID NO: 308, at one or more amino acid positions (e.g., at 1, 2, 3, 4, 5, 6, 7, 8, 9, 10, 11, 12, 14, 15, 20 or more amino acid positions compared to SEQ ID NO: 308, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 308.

In some embodiments, the engineered TAL polypeptides of the invention having TAL activity comprise a) an amino acid sequence having at least 85% sequence identity to reference sequence SEQ ID NO: 338, or a fragment thereof; b) an amino acid residue difference as compared to SEQ ID NO: 338, at one or more amino acid positions; and c) which exhibits improved activity, as compared to SEQ ID NO: 338 and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 338 and an amino acid residue difference as compared to SEQ ID NO: 338, at one or more amino acid positions (e.g., at 1, 2, 3, 4, 5, 6, 7, 8, 9, 10, 11, 12, 14, 15, 20 or more amino acid positions compared to SEQ ID NO: 338, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 338.

In some embodiments, the engineered TAL polypeptides of the invention having TAL activity comprise a) an amino acid sequence having at least 85% sequence identity to reference sequence SEQ ID NO: 504, or a fragment thereof; b) an amino acid residue difference as compared to SEQ ID NO: 504, at one or more amino acid positions; and c) which exhibits improved activity, as compared to SEQ ID NO: 504 and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 504 and an amino acid residue difference as compared to SEQ ID NO: 504, at one or more amino acid positions (e.g., at 1, 2, 3, 4, 5, 6, 7, 8, 9, 10, 11, 12, 14, 15, 20 or more amino acid positions compared to SEQ ID NO: 504, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 504.

In some embodiments, the engineered TAL polypeptides of the invention having TAL activity comprise a) an amino acid sequence having at least 85% sequence identity to reference sequence SEQ ID NO: 736, or a fragment thereof; b) an amino acid residue difference as compared to SEQ ID NO: 736, at one or more amino acid positions; and c) which exhibits improved activity, as compared to SEQ ID NO: 736 and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 736 and an amino acid residue difference as compared to SEQ ID NO: 736, at one or more amino acid positions (e.g., at 1, 2, 3, 4, 5, 6, 7, 8, 9, 10, 11, 12, 14, 15, 20 or more amino acid positions compared to SEQ ID NO: 736, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 736.

In some embodiments, when all other assay conditions are essentially the same, the engineered TAL polypeptide has improved activity as compared to a reference TAL polypeptide. In some embodiments this activity can be measured under conditions that monitor enzymatic activity at saturating levels of tyrosine, thus assessing the maximum activity of the enzyme ($k_{cat}$). In other embodiments this activity can be measured under substrate concentrations resulting in one-half, one-fifth, one-tenth or less of maximal activity. Under either method of analysis, the engineered polypeptide has improved activity levels about 1.0 fold, 1.5-fold, 2-fold, 5-fold, 10-fold, 20-fold, 25-fold, 50-fold, 75-fold, 100-fold, or more of the enzymatic activity of the reference TAL In some embodiments, the engineered TAL polypeptide having improved activity as compared to a reference TAL when measured by any standard assay, including, but not limited to the assays described in the Examples.

In light of the guidance provided herein, it is further contemplated that any of the exemplary engineered polypeptides (e.g., SEQ ID NOS: 6, 8, 10, 12, 14, 28, 92, 308, 338, 504, and/or 736) can be used as the starting amino acid sequence for synthesizing other engineered TAL polypeptides, for example by subsequent rounds of evolution by adding new combinations of various amino acid differences from other polypeptides and other residue positions described herein. Further improvements may be generated by including amino acid differences at residue positions that had been maintained as unchanged throughout earlier rounds of evolution.

Polynucleotides Encoding Engineered Polypeptides, Expression Vectors and Host Cells:

The present invention provides polynucleotides encoding the engineered TAL polypeptides described herein. In some embodiments, the polynucleotides are operatively linked to one or more heterologous regulatory sequences that control gene expression to create a recombinant polynucleotide capable of expressing the polypeptide. Expression constructs containing a heterologous polynucleotide encoding the engineered TAL polypeptides can be introduced into appropriate host cells to express the corresponding TAL polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the engineered TAL polypeptide. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the variants provided in Table 2-1, 3-1, 4-1, 5-1, 6-1, 6-2, 7-1, and/or 8-1, as well as SEQ ID NOS: 2, 4, 6, 28, 92, 308, 338, 504, and 736.

In various embodiments, the codons are preferably selected to fit the host cell in which the protein is being produced. For example, preferred codons used in bacteria are used for expression in bacteria. Consequently, codon optimized polynucleotides encoding the engineered TAL polypeptides contain preferred codons at about 40%, 50%, 60%, 70%, 80%, or greater than 90% of codon positions of the full length coding region.

In some embodiments, as described above, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NOS: 2, 4, 6, 28, 92, 308, 338, 504, and 736, or the amino acid sequence of any variant as disclosed in Tables 2-1, 3-1, 4-1, 5-1, 6-1, 6-2, 7-1, and 8-1, and one or more residue differences as compared to the reference polypeptide of SEQ ID NOS: 2, 4, 6, 28, 92, and/or 308, or the amino acid sequence of any variant as disclosed in Table 2-1, 3-1, 4-1, 5-1, 6-1, 6-2, 7-1, and/or 8-1 (e.g., 1, 2, 3, 4, 5, 6, 7, 8, 9, 10 or more amino acid residue positions). In some embodiments, the reference sequence is selected from SEQ ID NOS: 2, 4, 6, 28, 92, 308, 338, 504, and 736.

In some embodiments, the polynucleotide encoding the engineered TAL polypeptides comprises a polynucleotide sequence selected from a polynucleotide sequence encoding the SEQ ID NOS: 4, 6, 28, 92, 308, 338, 504, and 736. In some embodiments, the polynucleotide encoding an engineered TAL polypeptide has at least 80%, 85%, 90%, 93%, 95%, 96%, 97%, 98%, 99% nucleotide residue identity to SEQ ID NOS: 3, 5, 27, 92, 308, 338, 504, and 736. In some embodiments, the polynucleotides are capable of hybridizing under highly stringent conditions to a reference polynucleotide sequence selected from SEQ ID NOS: 3, 5, 28, 92, 308, 338, 504, and 736, or a complement thereof, or a polynucleotide sequence encoding any of the variant TAL polypeptides provided herein.

In some embodiments, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 6, and one or more residue differences as compared to SEQ ID NO: 6 at residue positions selected from 16/18/39/47/54/59/73/91/209/214/285/290/305/307/364/407/503/521/524/565, 16/18/39/47/54/59/73/91/209/214/285/290/307/364/407/450/470/503/521/524/565, 16/18/39/47/54/59/73/91/209/214/285/290/407/503/521/524/565, 16/18/39/47/54/59/73/91/209/214/290/305/307/364/407/470/503/521/524/565, 16/18/39/47/54/59/73/91/209/285/290/307/364/407/450/470/503/521/524/565, 16/18/39/47/54/59/73/91/214/285/290/364/403/407/450/470/503/521/524, 16/18/39/47/54/59/73/91/285/290/305/307/364/407/470/503/521/524/565, 16/18/39/54/73/91/209/210/285/290/307/364/407/450/470/503/521/524, 16/39/47/54/59/73/91/98/209/214/285/290/307/407/450/470/503, 16/39/47/54/59/73/91/209/214/285/290/305/307/364/407/450/470/521/524/565, 16/39/47/54/59/73/91/209/214/285/290/305/307/364/407/450/503/521/565, 16/39/47/54/59/73/91/209/214/285/290/305/307/364/407/470/503/521, 16/39/47/54/59/73/91/209/214/285/290/305/307/364/407/470/503/521/524/565, 16/39/47/54/59/73/91/209/214/285/290/305/364/503/524/565, 16/39/47/54/59/73/91/209/214/285/290/307/364/407/470/503/521/524/565, 16/39/47/54/59/73/91/209/285/290/305/307/364/407/470/503/521/524/565, 16/39/47/54/59/73/209/214/285/290/307/364/470/503/521/524/565, 16/39/54/59/73/91/209/214/285/290/364/450/470/503/521/524, 16/54/59/73/91/209/214/285/290/307/364/407/450/503/521/524/565, 18/39/47/54/59/73/91/209/214/285/290/305/307/364/407/503/521/524, 18/39/47/54/59/73/91/209/214/285/290/305/307/364/407/503/521/524/565, 18/39/47/54/59/73/91/285/290/305/307/364/407/470/521/524/565, 18/39/47/54/59/91/209/214/285/290/307/364/407/450/470/503/521/524/565, 18/39/47/54/73/91/98/209/214/285/290/305/307/364/407/470/503/521/524/565, 18/39/47/54/73/91/209/214/285/290/305/364/407/470/503/521/524, 18/39/47/54/73/91/209/214/285/290/305/307/364/407/470/503/521/524, 18/39/47/54/73/91/209/285/290/305/307/364/407/470/503/521/524, 18/39/54/59/73/91/209/214/285/290/307/364/407/470/503/521/524/565, 18/47/54/59/73/91/285/290/307/364/470/503/521/524/565, 39/47/54/59/73/91/209/210/285/290/307/364/407/450/470/503/521/524/565, 39/47/54/73/91/209/214/285/290/364/407/450/470/503/521/524/565, 39/47/59/73/91/209/214/285/290/305/307/364/407/470/503/521/524/565, 39/54/59/73/91/209/214/285/290/364/407/470/503/524/565, and 39/54/59/73/91/285/290/307/450/470/503/524/565, when aligned with the polypeptide of SEQ ID NO: 6. In some embodiments, the polynucleotides are capable of hybridizing under highly stringent conditions to SEQ ID NO: 5, or a complement thereof.

In some embodiments, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 28, and one or more residue differences as compared to SEQ ID NO: 28 at residue positions selected from 18/222, 18/222/364/400, 18/222/400/490, 18/364/400, 18/364/453, 18/389/400/490, 18/389/490, 18/400, 77/222/389, 222/364/389, 222/453, 315, 315/364, 315/389/453, 389/400, 400, and 400/453, when aligned with the polypeptide of SEQ ID NO: 28. In some embodiments, the polynucleotides are capable of hybridizing under highly stringent conditions to SEQ ID NO: 27, or a complement thereof.

In some embodiments, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 92, and one or more residue differences as compared to SEQ ID NO: 92 at residue positions selected from 43/410/413, 49/114/204/425, 61, 72, 72/306/307, 72/306/309, 73, 98, 98/404/410, 104, 106, 110, 112, 114, 114/145/204/258/275, 114/145/204/275/424/435, 114/145/247, 114/145/275, 114/145/275/344/424/435, 114/176, 114/176/518, 114/204, 114/204/247/258, 114/204/258/424/435, 114/204/266/425, 114/204/275/425, 114/204/275/518, 114/204/344, 114/204/435, 114/204/435/518, 114/204/518, 114/247/275/344/518, 114/258/275, 114/258/424/425/518, 114/518, 119/404/410, 145/204/275/435, 145/258/275/518, 145/424/435, 145/435, 175, 176/204, 176/204/518, 176/247, 176/247/258, 176/258/518, 176/275, 176/518, 204, 204/247/258/275, 204/247/435, 204/247/518, 204/258/275, 204/275/344, 204/518, 214, 247, 247/258, 247/258/518, 247/275/344/518, 247/424/435, 247/518, 258/344, 258/435, 275, 275/344, 306, 306/307/309, 306/307/394, 306/307/394/404/410, 306/410, 307, 344, 344/424/435/518, 345, 378/407, 394/410, 394/413, 395, 407, 410, 410/517, 413, 413/557, 418, 424, 424/435, 435, 435/518, 450, 464, and 518, when aligned with the polypeptide of SEQ ID NO: 92. In some embodiments, the polynucleotides are capable of hybridizing under highly stringent conditions to SEQ ID NO: 91, or a complement thereof.

In some embodiments, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 308, and one or more residue differences as compared to SEQ ID NO: 308 at residue positions selected from 27, 31, 32/119/237/513/534, 32/119/509/513/534, 36, 54, 56, 58, 61, 61/214/464, 68, 69, 114, 114/119, 114/410/413/418, 118, 119/145/237/331, 119/237/254/513, 119/331/509/513, 119/509/513, 145/237/509/513/534, 158/509/513/534, 158/534, 189, 193, 209, 214, 214/410/450/464, 237, 237/254/331, 237/509/513, 237/513, 237/513/534, 249/339, 266, 270, 270/532, 282, 286, 289, 289/517, 331, 335, 338, 339, 353, 354, 355, 394/410/464, 394/464, 410/418/450/464, 418, 464, 467, 470, 497, 502, 509/513, 509/513/534, 513/534, 517, 522, 524, 525, 547, 551, 554, and 560, when aligned with the polypeptide of SEQ ID NO: 308. In some embodiments, the polynucleotides are capable of hybridizing under highly stringent conditions to SEQ ID NO: 307, or a complement thereof.

In some embodiments, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 338, and one or more residue differences as compared to SEQ ID NO: 338 at residue positions selected from 27/31/54, 27/31/502/534, 27/282/410, 31/54, 31/54/237/282, 31/54/282/335/502, 31/237/335, 31/237/335/502, 31/282, 31/335, 31/410, 31/502, 31/534/547, 36/114/119/289/554, 54/237, 54/335/355/410/502, 61/114/119/286/289/551/554, 61/119/339/551/554, 114, 114/119/254/289, 114/119/254/289/551, 114/119/339/364, 114/119/554, 114/286/339/418, 114/364/554, 119/254/286/339/364/418/551, 119/254/289/554, 119/339/364/418/551, 119/339/554, 119/418/551/554, 119/551/554, 119/554, 237/282/410/502, 237/410/502, 237/517, 254, 254/286/289/554, 254/289/339/418/554, 254/418, 282/410, 282/410/502/517/547, 282/502, 286/289, 286/289/418/554, 289, 289/551, 335/410, 339/418/551, 410/547, 502, and 554, when aligned with the polypeptide of SEQ ID NO: 338. In some embodiments, the polynucleotides are capable of hybridizing under highly stringent conditions to SEQ ID NO: 337, or a complement thereof.

In some embodiments, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 338, and one or more residue differences as compared to SEQ ID NO: 338 at residue positions selected from 116, 130, 133, 136, 158, 162, 211, 251, 267, 280, 319, 343, 356, 366, 367, 369, 386, 390, 403, 428, 439, 440, 443, 444, 462, 463, 474, 477, 478, 479, 481, 530, and 541, when aligned with the polypeptide of SEQ ID NO: 338. In some embodiments, the polynucleotides are capable of hybridizing under highly stringent conditions to SEQ ID NO: 337, or a complement thereof.

In some embodiments, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 504, and one or more residue differences as compared to SEQ ID NO: 504 at residue positions selected from 54, 54/116/119/364, 54/119/162/364/410, 54/364/403, 54/410/463, 54/462, 54/463, 54/530, 116/162/364, 119/162, 119/162/410, 410, 462, and 474, when aligned with the polypeptide of SEQ ID NO: 504. In some embodiments, the polynucleotides are capable of hybridizing under highly stringent conditions to SEQ ID NO: 504, or a complement thereof.

In some embodiments, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 736, and one or more residue differences as compared to SEQ ID NO: 736 at residue positions selected from 18, 18/52/463, 18/254, 18/267/554, 18/289, 18/289/339/364/554, 18/289/534/554, 18/289/554, 18/339/418/463, 18/339/463, 18/339/534, 254/289/339/418/463/554, 289/315/339/364/418/463/551, 289/534/554, 339/364/463, 534, and 534/551/554, when aligned with the polypeptide of SEQ ID NO: 736. In some embodiments, the polynucleotides are capable of hybridizing under highly stringent conditions to SEQ ID NO: 735, or a complement thereof.

In some embodiments, an isolated polynucleotide encoding any of the engineered TAL polypeptides provided herein is manipulated in a variety of ways to provide for expression of the polypeptide. In some embodiments, the polynucleotides encoding the polypeptides are provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable promoters can be selected based on the host cells used. For bacterial host cells, suitable promoters for directing transcription of the nucleic acid constructs of the present application, include, but are not limited to the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/ glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence comprises a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Biol., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region that directs the expressed polypeptide into the secretory pathway of a host cell of choice finds use for expression of the engineered TAL polypeptides provided herein. Effective signal peptide coding regions for bacterial host cells include, but are not limited to the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide. The propeptide coding region includes, but is not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention also provides a recombinant expression vector comprising a polynucleotide encoding an engineered TAL polypeptide, and one or more expression regulating regions such as a promoter and a terminator, a replication origin, etc., depending on the type of hosts into which they are to be introduced. In some embodiments, the various nucleic acid and control sequences described above are joined together to produce a recombinant expression vector which includes one or more convenient restriction sites to allow for insertion or substitution of the nucleic acid sequence encoding the variant TAL polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant TAL polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered TAL polypeptide of the present application, the polynucleotide being operatively linked to one or more control sequences for expression of the engineered TAL enzyme(s) in the host cell. Host cells for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* and *Pichia pastoris* (ATCC Accession No. 201178)); insect cells such as Drosophila S2 and Spodoptera Sf9 cells; animal cells such as CHO, COS, BHK, 293, and Bowes melanoma cells; and plant cells. Exemplary host cells are *Escherichia coli* strains (such as W3110 (ΔfhuA) and BL21).

Accordingly, in another aspect, the present invention provides methods for producing the engineered TAL polypeptides, where the methods comprise culturing a host cell capable of expressing a polynucleotide encoding the engineered TAL polypeptide under conditions suitable for expression of the polypeptide. In some embodiments, the methods further comprise the steps of isolating and/or purifying the TAL polypeptides, as described herein.

Appropriate culture media and growth conditions for the above-described host cells are well known in the art. Polynucleotides for expression of the TAL polypeptides may be introduced into cells by various methods known in the art. Techniques include, among others, electroporation, biolistic particle bombardment, liposome mediated transfection, calcium chloride transfection, and protoplast fusion.

The engineered TAL with the properties disclosed herein can be obtained by subjecting the polynucleotide encoding the naturally occurring or engineered TAL polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related non-US counterparts; Ling et al., Anal. Biochem., 254:157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; WO 2009/152336, and U.S. Pat. No. 6,537,746, all of which are incorporated herein by reference).

In some embodiments, the enzyme clones obtained following mutagenesis treatment are screened by subjecting the enzymes to a defined temperature (or other assay conditions) and measuring the amount of enzyme activity remaining after heat treatments or other assay conditions. Clones containing a polynucleotide encoding a TAL polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tetra. Lett., 22:1859-69 [1981]; and Matthes et al., EMBO J., 3:801-05 [1984]), as it is typically practiced in automated synthetic methods. According to the phosphoramidite method, oligonucleotides are synthesized (e.g., in an automatic DNA synthesizer), purified, annealed, ligated and cloned in appropriate vectors.

Accordingly, in some embodiments, a method for preparing the engineered TAL polypeptide can comprise: (a) synthesizing a polynucleotide encoding a polypeptide comprising an amino acid sequence selected from the amino acid sequence of any variant provided in Table 2-1, 3-1, 4-1, and/or 5-1, as well as SEQ ID NOS: 2, 4, 6, 28, 92, and 308, and (b) expressing the TAL polypeptide encoded by the polynucleotide. In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

The expressed engineered TAL polypeptide can be measured for any desired improved property (e.g., activity, selectivity, stability, acid tolerance, protease sensitivity, etc.), using any suitable assay known in the art, including but not limited to the assays and conditions described herein.

In some embodiments, any of the engineered TAL polypeptides expressed in a host cell are recovered from the cells and/or the culture medium using any one or more of the well-known techniques for protein purification, including, among others, lysozyme treatment, sonication, filtration, salting-out, ultra-centrifugation, and chromatography.

Chromatographic techniques for isolation of the TAL polypeptides include, among others, reverse phase chromatography high performance liquid chromatography, ion exchange chromatography, hydrophobic interaction chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved variant TAL enzymes. In some embodiments utilizing affinity chromatography purification, any antibody which specifically binds the variant TAL polypeptide finds use. For the production of antibodies, various host animals, including but not limited to rabbits, mice, rats, etc., are immunized by injection with a TAL polypeptide (e.g., a TAL variant), or a fragment thereof. In some embodiments, the TAL polypeptide or fragment is attached to a suitable carrier, such as BSA, by means of a side chain functional group or linkers attached to a side chain functional group.

In some embodiments, the engineered TAL polypeptide is produced in a host cell by a method comprising culturing a host cell (e.g., an *E. coli* strain) comprising a polynucleotide sequence encoding an engineered TAL polypeptide as described herein under conditions conducive to the production of the engineered TAL polypeptide and recovering the engineered TAL polypeptide from the cells and/or culture medium.

In some preferred embodiments, the invention encompasses a method of producing an engineered TAL polypeptide comprising culturing a recombinant bacterial cell comprising a polynucleotide sequence encoding an engineered TAL polypeptide having at least 85%, 90%, 95%, 96%, 97%, 98%, 99%, or 100% sequence identity to reference sequences SEQ ID NOS: 2, 4, 6, 28, 92, 308, 338, 504, and/or 736, and one or more amino acid residue differences as compared to SEQ ID NO: 2, 4, 6, 28. 92, 308, 338, 504, and/or 736, and/or combinations thereof when aligned, under suitable culture conditions to allow the production of the engineered TAL polypeptide and optionally recovering the engineered TAL polypeptide from the culture and/or cultured bacterial cells.

In some embodiments, once the engineered TAL polypeptides are recovered from the recombinant host cells or cell culture and they are further purified by any suitable method(s) known in the art. In some additional embodiments, the purified TAL polypeptides are combined with other ingredients and compounds to provide compositions and formulations comprising the engineered TAL polypeptide as appropriate for different applications and uses (e.g., pharmaceutical compositions).

Compositions:

Pharmaceutical Compositions

The present invention provides engineered TAL polypeptides suitable for use in pharmaceutical and other compositions, such as dietary/nutritional supplements.

Depending on the mode of administration, the compositions comprising a therapeutically effective amount of an engineered TAL according to the present invention are in the form of a solid, semi-solid, gel, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature.

In some embodiments, the engineered TAL polypeptides are formulated for use in oral pharmaceutical compositions. Any suitable format for use in delivering the engineered TAL polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, suspensions (including but not limited to oil-based suspensions, oil-in water emulsions, etc.), slurries, syrups, controlled release formulations, suppositories, etc. In some embodiments, the engineered TAL polypeptides are provided in a format suitable for injection (i.e., in an injectable formulation).

In some embodiments, the engineered TAL polypeptides are provided in biocompatible matrices such as sol-gels, including silica-based (e.g., oxysilane) sol-gels. In some embodiments, the engineered TAL polypeptides are encapsulated. In some alternative embodiments, the engineered TAL polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered TAL polypeptides be administered by any suitable means known in the art, including but not limited to parenteral, oral, topical, transdermal, intranasal, intraocular, intrathecal, via implants, etc.

In some embodiments, the engineered TAL polypeptides are chemically modified by glycosylation, pegylation (i.e., modified with polyethylene glycol [PEG] or activated PEG, etc.) or other compounds (See e.g., Ikeda, Amino Acids 29:283-287 [2005]; U.S. Pat. Nos. 7,531,341, 7,534,595, 7,560,263, and 7,553,653; U.S. Pat. Appln. Publ. Nos. 2013/0039898, 2012/0177722, etc.). Indeed, it is not intended that the present invention be limited to any particular delivery method and/or mechanism.

In some additional embodiments, the engineered TAL polypeptides are provided in formulations comprising matrix-stabilized enzyme crystals. In some embodiments, the formulation comprises a cross-linked crystalline engineered TAL enzyme and a polymer with a reactive moiety that adheres to the enzyme crystals. The present invention also provides engineered TAL polypeptides in polymers.

In some embodiments, compositions comprising the engineered TAL polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropylmethyl cellulose, sodium carboxy-methylcellulose), gums (e.g., arabic, tragacanth, guar, etc.), and/or proteins (e.g., gelatin, collagen, etc.). Additional components in oral formulations may include coloring and or sweetening agents (e.g., glucose, sucrose, and mannitol) and lubricating agents (e.g., magnesium stearate), as well as enteric coatings (e.g., methacrylate polymers, hydroxyl propyl methyl cellulose phthalate, and/or any other suitable enteric coating known in the art). In some embodiments, disintegrating or solubilizing agents are included (e.g., cross-linked polyvinyl pyrrolidone, agar, alginic acid or salts thereof, such as sodium alginate). In some embodiments, the engineered TAL polypeptide are be combined with various additional components, including but not limited to preservatives, suspending agents, thickening agents, wetting agents, alcohols, fatty acids, and/or emulsifiers, particularly in liquid formulations. In some embodiments, the engineered TAL polypeptides are administered to subjects in combination with other compounds used in the treatment of tyrosinemia and/or alkaptonuria, including but not limited to NTBC, nitisinone, antacids (e.g., omeprazole, esomeprazole and other prazoles), as well as any other suitable compounds. In some embodiments, the engineered TAL polypeptides are administered in combination with at least one phenylalanine ammonia lyase.

In some embodiments, the present invention provides engineered TAL polypeptides suitable for use in decreasing the concentration of tyrosine in fluids such as blood, cerebrospinal fluid, etc.

The dosages of engineered TAL polypeptide(s) administered to an animal depend upon the condition or disease, the general condition of the animal, and other factors known to those in the art. In some embodiments, the compositions are intended for single or multiple administrations to an animal. In some embodiments, it is contemplated that the concentration of engineered TAL polypeptide(s) in the composition (s) administered to an animal (e.g., a human with tyrosinemia or alkaptonuria) is sufficient to effectively treat, ameliorate and/or prevent the symptoms of disease (e.g., tyrosinemia or alkaptonuria and/or tyrosinemia or alkaptonuria-related conditions, diseases and/or symptoms), In some embodiments, the engineered TAL polypeptides are administered in combination with other pharmaceutical and/or dietary compositions. In some embodiments, the engineered TAL polypeptides are administered in combination with at least one phenylalanine ammonia lyase.

Industrial Compositions

It is contemplated that the engineered TAL polypeptides of the present invention will find use in industrial compositions. In some embodiments, the engineered TAL polypeptides find use in the production of chemicals (e.g., coumaric acid). In some embodiments, the engineered TAL polypeptides are formulated for use in the food and/or feed industries. In some embodiments, the engineered TAL polypeptides are formulated in granulated or pelleted products which are mixed with animal feed components such as additional enzymes (for example, cellulases, laccases, and amylases).

In some alternative embodiments, the engineered TAL polypeptides are used in liquid animal feed compositions (e.g., aqueous or oil based slurries). Thus, in some embodiments, the engineered TAL variants of the present invention are sufficiently thermotolerant and thermostable to withstand the treatment used to produce pellets and other processed feed/foods. In some further embodiments, the engineered TAL variants are used to produce tyrosine and/or tyrosine derivatives.

The engineered TAL polypeptides provided herein also find use in agricultural applications. Indeed, it is contemplated that modulation of TAL activity by using recombinant polypeptides having TAL activity will lead to effective herbicides.

The foregoing and other aspects of the invention may be better understood in connection with the following non-limiting examples. The examples are provided for illustrative purposes only and are not intended to limit the scope of the present invention in any way.

EXPERIMENTAL

The following Examples, including experiments and results achieved, are provided for illustrative purposes only and are not to be construed as limiting the present invention. In the experimental disclosure below, the following abbreviations apply: ppm (parts per million); M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); ° C. (degrees Centigrade); CDS (coding sequence); DNA (deoxyribonucleic acid); RNA (ribonucleic acid); *E. coli* W3110 (commonly used laboratory *E. coli* strain, available from the Coli Genetic Stock Center [CGSC], New Haven, Conn.); HPLC (high pressure liquid chromatography); SDS-PAGE (sodium dodecyl sulfate polyacrylamide gel electrophoresis); PES (polyethersulfone); CFSE (carboxyfluorescein succinimidyl ester); IPTG (isopropyl β-D-1-thiogalactopyranoside); PMBS (polymyxin B sulfate); NADPH (nicotinamide adenine dinucleotide phosphate); FIOPC (fold improvements over positive control); PHE and Phe (phenylalanine); TYR and Tyr (tyrosine); PBMC (peripheral blood mononuclear cells); LB (Luria broth); MeOH (methanol); Athens Research (Athens Research Technology, Athens, Ga.); ProSpec (ProSpec Tany Technogene, East Brunswick, N.J.); Sigma-Aldrich (Sigma-Aldrich, St. Louis, Mo.); Ram Scientific (Ram Scientific, Inc., Yonkers, N.Y.); Pall Corp. (Pall, Corp., Pt. Washington, N.Y.); Millipore (Millipore, Corp., Billerica Mass.); Difco (Difco Laboratories, BD Diagnostic Systems, Detroit, Mich.); Molecular Devices (Molecular Devices, LLC, Sunnyvale, Calif.); Kuhner (Adolf Kuhner, AG, Basel, Switzerland); Cambridge Isotope Laboratories, (Cambridge Isotope Laboratories, Inc. Tewksbury, Mass.); Applied Biosystems (Applied Biosystems, part of Life Technologies, Corp., Grand Island, N.Y.); Greiner Bio-One (Greiner Bio-One North America, Monroe, N.C.); Agilent (Agilent Technologies, Inc., Santa Clara, Calif.); Thermo Scientific (part of Thermo Fisher Scientific, Waltham, Mass.); Corning (Corning, Inc., Palo Alto, Calif.); Megazyme (Megazyme International, Wicklow, Ireland); Enzo (Enzo Life Sciences, Inc., Farmingdale, N.Y.); GE Healthcare (GE Healthcare Bio-Sciences, Piscataway, N.J.); Pierce (Pierce Biotechnology (now part of Thermo Fisher Scientific), Rockford, Ill.); Phenomenex (Phenomenex, Inc., Torrance, Calif.); Optimal (Optimal Biotech Group, Belmont, Calif.); and Bio-Rad (Bio-Rad Laboratories, Hercules, Calif.).

Example 1

Synthesis, Optimization, and Assaying of TAL Enzymes with Tyrosine Ammonia Lyase Activity In this Example, methods used in the synthesis, optimization and assaying of TAL enzymes with tyrosine ammonia lyase activity are described.
TAL Gene Acquisition and Construction of Expression Vectors:
A synthetic gene (SEQ ID NO: 1) encoding *Anabaena variabilis* phenylalanine ammonia lyase (AvPAL) (SEQ ID NO: 2) optimized for expression in *E. coli* was subcloned as described in Example 1 of U.S. Pat. No. 9,611,468 (hereby incorporated by reference in its entirety). This plasmid construct was transformed into an *E. coli* strain derived from W3110. Targeted mutagenesis of WT AvPAL (SEQ ID NO: 2) and an evolved variant resistant to proteolytic degradation were performed to generate the F107H variant of these enzymes (SEQ ID NO: 6 and SEQ ID NO: 4). Directed evolution techniques generally known by those skilled in the art were used to generate libraries of gene variants from this plasmid construct (See e.g., U.S. Pat. No. 8,383,346, and WO2010/144103) as well as AvPAL derivatives. In some embodiments, expression vectors lacking antimicrobial resistance markers find use.
Lyophilized Lysates from Shake Flask (SF) Cultures:
*E. coli* cultures transformed with plasmids containing TAL variants were plated onto Luria Broth-agar plates with 1% glucose and 30 μg/mL chloramphenicol and grown overnight at 37° C. A single colony from each culture was transferred to 5 mL of Luria Broth (LB) with 1% glucose and 30 μg/mL chloramphenicol. The cultures were grown for 18 h at 30° C., 250 rpm, and subcultured approximately 1:50 into 250 ml of Terrific Broth (TB) with 30 μg/mL of chloramphenicol. The cultures were grown for approximately 3 h at 30° C., 250 rpm, to an $OD_{600}$ of 0.6-0.8 and induced with 1 mM of IPTG. The cultures were grown for 20 h at 30° C., 250 rpm. Cells were harvested by centrifugation (7000 rpm×10 min, 4° C.), and the supernatant was discarded. The pellets were resuspended in 30 mL of 20 mM sodium phosphate, 150 mM NaCl, pH 8.0, and lysed using a single pass through a microfluidizer (Microfluidics) at 110 psi. The lysate was pelleted (10,000×rpm, 30 min, 4° C.), and the supernatant was frozen and lyophilized to generate a powder containing the produced enzyme.
Demonstration of Tyrosine Ammonia Lyase Activity:
The lyophilized powders were reconstituted in water to provide 20 g/L powder in buffer, serially diluted, and assayed against 5 mM phenylalanine (phe) or 2 mM tyrosine (tyr) in 100 mM sodium phosphate at pH 7.0. The reaction components were mixed briefly, and the activity was determined by tracking the absorbance at 290 nm over time (every 14 s over 5-10 min.) using a Spectra Max® Plus$^{384}$ or a SpectraMax® 190 (Molecular Devices) absorbance microplate reader. High activity on both phenylalanine and tyrosine was observed for SEQ ID NO: 4.

Example 2

TAL Variants of SEQ ID NO: 4

In this Example, experiments involving evolution and screening of TAL variants derived from SEQ ID NO: 4 for improved tyrosine activity and protease stability are described. Directed evolution of the TAL encoded by SEQ ID NO: 4 was carried out by constructing libraries of variant genes. These libraries were then plated, grown, and screened using the methods described below.
High-Throughput (HTP) Growth of TAL and TAL Variants:
Transformed *E. coli* cells were selected by plating onto LB agar plates containing 1% glucose and 30 μg/mL chloramphenicol. After overnight incubation at 37° C., colonies were picked into NUNC™ (Thermo-Scientific) 96-well shallow flat bottom plates filled with 180 μL/well LB-medium supplemented with 1% glucose and 30 μg/mL chloramphenicol. Cultures were allowed to grow overnight for 18-20 hours in a shaker (200 rpm, 30° C., and 85% relative humidity; Kuhner). Overnight growth samples (20 μL) were transferred into Costar 96-well deep plates filled with 380 μL of TB supplemented with 30 μg/mL chloramphenicol. Cultures were incubated for 2-3 hours in a shaker (250 rpm, 30° C., and 85% relative humidity; Kuhner) and then induced with 40 μL of 10 mM IPTG in sterile water and incubated overnight for 20-24 hours in a shaker (250 rpm, 30° C., and 85% relative humidity; Kuhner). Cells were pelleted (4000 rpm×10 min), supernatants were discarded, and cells were frozen at −80° C. prior to analysis.

Lysis of HTP Pellets:

E. coli cell pellets were lysed with 200 µL of lysis buffer (1 mg/ml lysozyme+0.5 g/L PMBS in 20 mM Tris pH 7.5). The mixture was agitated for 2 hours at room temperature, and pelleted (4000 rpm×10 min) after which the clarified lysates were used in HTP assays or preincubated for 1 hour at 55° C. in a Thermotron® titre-plate shaker (400 rpm). The heat-treated lysates were pelleted (4000 rpm×10 min), and the supernatant was used in HTP assays.

HTP-Analysis of Clarified Lysates:

TAL variant activity was assayed by measuring the formation of coumaric acid as determined by the change in absorbance at 290 nm over time. Reactions were prepared by the addition of 155-180 µL of 200 mM sodium phosphate, 1.4-2.5 mM tyrosine, pH 7.0 and 20-45 µL of unheated or heat-treated clarified lysate to a 96-well UV-Star® plate (Greiner Bio-One). The reactions were mixed briefly, and the activity was determined by tracking the absorbance at 290 nm over time (every 14-37 s over 5-10 min.) using a SpectraMax® Plus[384] or a SpectraMax® 190 absorbance microplate reader (Molecular Devices).

TAL variant activity on phenylalanine was also assayed by measuring the formation of cinnamic acid as determined by the change in absorbance at 290 nm over time. Reactions were prepared by the addition of 155-180 µL of 200 mM sodium phosphate, 29-50 mM phenylalanine, pH 7.0 and 20-45 µL of heat-treated clarified lysate to a 96-well UV-Star® plate (Greiner Bio-One). The reactions were mixed briefly, and the activity was measured as described above. The results of these assays are shown in Table 2-1, and SEQ ID NO: 28 was selected for further directed evolution.

HTP-Analysis of Clarified Lysates Pretreated with Protease:

TAL variants were challenged with chymotrypsin and trypsin to simulate the environment of the intestine. First, 55 µL of protease mix (1 mg/mL chymotrypsin (Sigma Aldrich), 1 mg/mL trypsin (Sigma Aldrich), 4 mM sodium taurocholate, 0.2 mM $CaCl_2$, and 0.2 mM HCl) in 200 mM sodium phosphate pH 7.0 and 45 µL of heat-treated clarified lysate were added to a 96-well UV-Star® plate (Greiner Bio-One). The plates were sealed and incubated for 1 hour at 37° C. in a Thermotron® titre-plate shaker (400 rpm) prior to analysis. Residual activity was determined by adding 100 µL of 200 mM sodium phosphate, 50 mM phenylalanine, pH 7.0 to 100 µL of protease-treated lysate. The reactions were mixed briefly, and activity was determined as described above. The results of this assay are shown in Table 2-1.

TABLE 2-1

Relative Activity of TAL Variants on Tyrosine and Phenylalanine Under Various Conditions (Relative to SEQ ID NO: 4)[1]

| SEQ ID NO: (nt/aa) | Amino Acid Differences (Relative to SEQ ID NO: 6) | 1 mM tyr | 22 mM phe | 2.2 mM tyr (unheated lysate) | 45 mM phe | 25 mM phe with 1 mg/mL protease |
|---|---|---|---|---|---|---|
| 7/8 | F16S/F18H/A39V/L47A/T54K/G59R/S73K/A91V/L214Q/I285L/N290G/L364H/P403T/L407V/F450A/D470E/C503Q/Q521K/T524S | +++ | ++ | +++ | + | + |
| 9/10 | F16S/A39V/L47A/T54K/G59R/S73K/A91V/S209P/L214Q/I285L/N290G/R305M/L364H/C503Q/T524S/C565P | ++ | ++ | ++++ | + | + |
| 11/12 | A39V/T54K/G59R/S73K/A91V/S209P/L214Q/I285L/N290G/L364H/L407V/D470E/C503Q/T524S/C565P | ++++ | ++++ | ++++ | ++++ | + |
| 13/14 | F16S/A39V/L47A/T54K/G59R/S73K/A91V/S98G/S209P/L214Q/I285L/N290G/H307G/L407V/F450A/D470E/C503Q | ++++ | ++++ | ++++ | ++++ | + |
| 15/16 | A39V/L47A/G59R/S73K/A91V/S209P/L214Q/I285L/N290G/R305M/H307G/L364H/L407V/D470E/C503Q/Q521K/T524S/C565P | +++ | +++ | ++++ | ++ | + |
| 17/18 | F16S/A39V/T54K/G59R/S73K/A91V/S209P/L214Q/I285L/N290G/L364H/F450A/D470E/C503Q/Q521K/T524S | ++ | +++ | ++++ | +++ | + |
| 19/20 | F16S/A39V/L47A/T54K/G59R/S73K/A91V/S209P/I285L/N290G/R305M/H307G/L364H/L407V/D470E/C503Q/Q521K/T524S/C565P | ++++ | ++++ | ++++ | +++ | + |
| 21/22 | F18H/A39V/L47A/T54K/G59R/A91V/S209P/L214Q/I285L/N290G/H307G/L364H/L407V/F450A/D470E/C503Q/Q521K/T524S/C565P | ++++ | +++ | ++++ | +++ | + |
| 23/24 | A39V/T54K/G59R/S73K/A91V/I285L/N290G/H307G/F450A/D470E/C503Q/T524S/C565P | +++ | +++ | ++++ | ++ | + |
| 25/26 | F18H/A39V/L47A/T54K/S73K/A91V/S209P/L214Q/I285L/N290G/R305M/L364H/L407V/D470E/C503Q/Q521K/T524S | +++ | +++ | ++++ | ++ | + |
| 27/28 | F16S/A39V/L47A/T54K/G59R/S73K/A91V/S209P/L214Q/I285L/N290G/H307G/L364H/L407V/D470E/C503Q/Q521K/T524S/C565P | ++++ | ++++ | ++++ | ++++ | +++ |
| 29/30 | F18H/A39V/L47A/T54K/S73K/A91V/S209P/I285L/N290G/R305M/H307G/L364H/L407V/D470E/C503Q/Q521K/T524S | ++ | +++ | ++++ | ++ | ++ |

TABLE 2-1-continued

Relative Activity of TAL Variants on Tyrosine and Phenylalanine Under Various Conditions (Relative to SEQ ID NO: 4)[1]

| SEQ ID NO: (nt/aa) | Amino Acid Differences (Relative to SEQ ID NO: 6) | 1 mM tyr | 22 mM phe | 2.2 mM tyr (unheated lysate) | 45 mM phe | 25 mM phe with 1 mg/mL protease |
|---|---|---|---|---|---|---|
| 31/32 | F16S/F18H/A39V/L47A/T54K/G59R/ S73K/A91V/S209P/L214Q/I285L/N290G/ R305M/H307G/L364H/L407V/C503Q/ Q521K/T524S/C565P | +++ | +++ | ++++ | ++ | + |
| 33/34 | F18H/L47A/T54K/G59R/S73K/A91V/ I285L/N290G/H307G/L364H/ D470E/C503Q/Q521K/T524S/C565P | ++++ | ++++ | ++++ | +++ | + |
| 35/36 | F16S/F18H/A39V/L47A/T54K/G59R/ S73K/A91V/S209P/I285L/N290G/H307G/ L364H/L407V/F450A/D470E/C503Q/ Q521K/T524S/C565P | ++++ | ++++ | ++++ | ++ | + |
| 37/38 | F16S/A39V/L47A/T54K/G59R/S73K/ A91V/S209P/L214Q/I285L/N290G/ R305M/H307G/L364H/L407V/D470E/ C503Q/Q521K/T524S/C565P | ++ | +++ | ++++ | ++ | + |
| 39/40 | F16S/A39V/L47A/T54K/G59R/S73K/ A91V/S209P/L214Q/I285L/N290G/ R305M/H307G/L364H/L407V/F450A/ D470E/Q521K/T524S/C565P | +++ | +++ | + | + | + |
| 41/42 | F16S/F18H/A39V/L47A/T54K/ G59R/S73K/A91V/S209P/L214Q/N290G/ R305M/H307G/L364H/L407V/D470E/ C503Q/Q521K/T524S/C565P | +++ | +++ | ++++ | | + |
| 43/44 | A39V/L47A/T54K/G59R/S73K/A91V/ S209P/P210S/I285L/N290G/H307G/ L364H/L407V/F450A/D470E/C503Q/ Q521K/T524S/C565P | ++++ | ++++ | ++++ | ++ | + |
| 45/46 | F16S/A39V/L47A/T54K/G59R/S73K/ A91V/S209P/L214Q/I285L/N290G/ R305M/H307G/L364H/L407V/D470E/ C503Q/Q521K | +++ | ++++ | ++++ | ++ | + |
| 47/48 | F16S/F18H/A39V/L47A/T54K/G59R/ S73K/A91V/S209P/L214Q/I285L/ N290G/H307G/L364H/L407V/F450A/ D470E/C503Q/Q521K/T524S/C565P | ++++ | ++++ | ++++ | ++ | ++ |
| 49/50 | F18H/A39V/L47A/T54K/G59R/S73K/ A91V/I285L/N290G/R305M/H307G/ L364H/L407V/D470E/Q521K/T524S/C565P | ++++ | ++++ | ++++ | + | + |
| 51/52 | F16S/F18H/A39V/T54K/S73K/A91V/ S209P/P210S/I285L/N290G/ H307G/L364H/L407V/F450A/D470E/ C503Q/Q521K/T524S | ++++ | ++++ | ++++ | +++ | + |
| 53/54 | F18H/A39V/L47A/T54K/G59R/S73K/ A91V/S209P/L214Q/I285L/ N290G/R305M/H307G/L364H/L407V/ C503Q/Q521K/T524S | ++++ | ++++ | ++++ | ++ | ++ |
| 55/56 | F16S/A39V/L47A/T54K/G59R/S73K/ S209P/L214Q/I285L/N290G/ H307G/L364H/D470E/C503Q/Q521K/ T524S/C565P | ++++ | ++++ | ++++ | + | |
| 57/58 | F18H/A39V/L47A/T54K/S73K/A91V/ S98G/S209P/L214Q/I285L/N290G/ R305M/H307G/L364H/L407V/D470E/ C503Q/Q521K/T524S | ++++ | ++++ | ++++ | +++ | + |
| 59/60 | F16S/A39V/L47A/T54K/G59R/S73K/ A91V/S209P/L214Q/I285L/ N290G/R305M/H307G/L364H/L407V/ F450A/C503Q/Q521K/C565P | +++ | +++ | + | + | + |
| 61/62 | A39V/L47A/T54K/S73K/A91V/S209P/ L214Q/I285L/N290G/L364H/L407V/ F450A/D470E/C503Q/Q521K/T524S/C565P | ++++ | ++++ | ++++ | +++ | +++ |
| 63/64 | F16S/T54K/G59R/S73K/A91V/S209P/ L214Q/I285L/N290G/H307G/L364H/ L407V/F450A/C503Q/Q521K/T524S/C565P | ++++ | ++++ | ++++ | ++ | +++ |
| 65/66 | F18H/A39V/L47A/T54K/G59R/S73K/ A91V/S209P/L214Q/I285L/N290G/ R305M/H307G/L364H/L407V/C503Q/ Q521K/T524S/C565P | ++++ | ++++ | ++++ | ++ | +++ |
| 67/68 | F18H/A39V/T54K/G59R/S73K/A91V/ S209P/L214Q/I285L/N290G/ H307G/L364H/L407V/D470E/C503Q/ Q521K/T524S/C565P | ++++ | ++++ | ++++ | ++ | ++++ |

TABLE 2-1-continued

Relative Activity of TAL Variants on Tyrosine and Phenylalanine
Under Various Conditions (Relative to SEQ ID NO: 4)[1]

| SEQ ID NO: (nt/aa) | Amino Acid Differences (Relative to SEQ ID NO: 6) | 1 mM tyr | 22 mM phe | 2.2 mM tyr (unheated lysate) | 45 mM phe | 25 mM phe with 1 mg/ mL protease |
|---|---|---|---|---|---|---|
| 69/70 | F16S/F18H/A39V/L47A/T54K/G59R/ S73K/A91V/S209P/L214Q/I285L/ N290G/L407V/C503Q/Q521K/T524S/C565P | +++ | ++++ | ++++ | +++ | ++ |
| 71/72 | F16S/F18H/A39V/L47A/T54K/G59R/ S73K/A91V/I285L/N290G/R305M/H307G/ L364H/L407V/D470E/C503Q/Q521K/T524S/C565P | +++ | ++++ | ++++ | ++ | ++ |

[1] Levels of increased activity were determined relative to the reference polypeptide of SEQ ID NO: 4, and defined as follows: = """+""" .90 to 1.2; """++""" > 1.5; and """+++""" > 2.

Example 3

TAL Variants of SEQ ID NO: 28

In this Example, experiments involving evolution and screening of TAL variants derived from SEQ ID NO: 28 for improved tyrosine activity and protease stability are described. Directed evolution of the TAL encoded by SEQ ID NO: 28 was carried out by constructing libraries of variant genes. These libraries were then plated, grown, and screened using the methods described below.

High-Throughput (HTP) Growth of TAL and TAL Variants:

Transformed *E. coli* cells were selected by plating onto LB agar plates containing 1% glucose. After overnight incubation at 37° C., colonies were picked into NUNC™ (Thermo-Scientific) 96-well shallow flat bottom plates filled with 180 µL/well LB-medium supplemented with 1% glucose. Cultures were allowed to grow overnight for 18-20 hours in a shaker (200 rpm, 30° C., and 85% relative humidity; Kuhner). Overnight growth samples (20 µL) were transferred into Costar 96-well deep plates filled with 380 µL of TB. Cultures were incubated for 2-3 hours in a shaker (250 rpm, 30° C., and 85% relative humidity; Kuhner) and then induced with 40 µL of 10 mM IPTG in sterile water and incubated overnight for 20-24 hours in a shaker (250 rpm, 30° C., and 85% relative humidity; Kuhner). Cells were pelleted (4000 rpm×10 min), supernatants were discarded, and cells were frozen at −80° C. prior to analysis.

Lysis of HTP Pellets:

*E. coli* cell pellets were lysed with 400 µL of lysis buffer (1 mg/ml lysozyme+0.5 g/L PMBS in 20 mM sodium phosphate, 150 mM NaCl, pH 8.0). The mixture was agitated for 2 hours at room temperature, and pelleted (4000 rpm×10 min) after which the clarified lysates were preincubated for 2 h at 60° C. in a Thermotron® titre-plate shaker (400 rpm). The heat-treated lysates were pelleted (4000 rpm×10 min.), and the supernatant was used in HTP assays.

HTP-Analysis of Clarified Lysates:

TAL variant activity was assayed by measuring the formation of coumaric acid as determined by the change in absorbance at 290 nm over time. Reactions were prepared by the addition of 160-180 µL of 200 mM sodium phosphate, 0.125-2.5 mM tyrosine, pH 7.0 and 20-40 µL of heat-treated clarified lysate to a 96-well UV-Star® plate (Greiner Bio-One). The reactions were mixed briefly, and the activity was determined by tracking the absorbance at 290 nm over time (every 14-37s over 5-10 min) using a SpectraMax® Plus[384] or a SpectraMax® 190 absorbance microplate reader (Molecular Devices). The results of these assays are shown in Table 3-1, and SEQ ID NO: 92 was selected for further directed evolution.

TAL variant activity on phenylalanine was also assayed by measuring the formation of cinnamic acid as determined by the change in absorbance at 290 nm over time. Reactions were prepared by the addition of 180 µL of 200 mM sodium phosphate, 0.125-2.5 mM phenylalanine, pH 7.0 and 20 µL of heat-treated clarified lysate (diluted 5-fold in 20 mM sodium phosphate, 150 mM NaCl, pH 8.0) to a 96-well UV-Star® plate (Greiner Bio-One). The reactions were mixed briefly, and the activity was measured as described above. The results of these assays are shown in Table 3-1.

In some cases, TAL variant activity was measured over longer periods of time. Reactions were prepared by adding 180 µL of 200 mM sodium phosphate, 2.5 mM tyrosine or phenylalanine, pH 7.0 and 20 µL of heat-treated clarified lysate to a 96-well UV-Star® plate (Greiner Bio-One). The reactions were mixed briefly, and an initial absorbance was determined by measuring the absorbance at 290 nm using a SpectraMax® Plus[384] or a SpectraMax® 190 (Molecular Devices) absorbance microplate reader. After incubation at 37° C. for 4 h in a Thermotron® titre-plate shaker (400 rpm), the final absorbance was measured in a similar fashion. Activity was determined by subtracting the initial from the final absorbance, and results are shown in Table 3-1.

HTP-Analysis of Clarified Lysates Pretreated with Protease:

TAL variants were challenged with chymotrypsin and trypsin to simulate the environment of the intestine. First, 10 µL of protease mix (2.5 mg/mL chymotrypsin (Sigma Aldrich), 2.5 mg/mL trypsin (Sigma Aldrich)) in 200 mM sodium phosphate pH 7.0 and 40 µL of heat-treated clarified lysate were added to a 96-well UV-Star® plate (Greiner Bio-One). The plates were sealed and incubated for 1 hour at 37° C. in a Thermotron® titre-plate shaker (400 rpm) prior to analysis. Residual activity was determined by adding 160 µL of 200 mM sodium phosphate, 2.5 mM tyrosine, pH 7.0 to 50 µL of protease-treated lysate. The reactions were mixed briefly, and activity was determined as described above. The results of this assay are shown in Table 3-1.

TABLE 3-1

Relative Activity of TAL Variants on Tyrosine and Phenylalanine
Under Various Conditions (Relative to SEQ ID NO: 28)[1]

| SEQ ID NO: (nt/aa) | Amino Acid Differences (Relative to SEQ ID NO: 28) | 2 mM tyr | 0.1 mM tyr | Protease | 4 h tyr | 2 mM phe |
|---|---|---|---|---|---|---|
| 73/74 | F18H/M222T | + | +++ | +++ | ++ | + |
| 75/76 | M222T/N453C | ++ | ++++ | +++ | ++ | + |
| 77/78 | M222T/H364M/Q389T | + | ++ | +++ | + | + |
| 79/80 | F18H/N400M | ++ | +++ | ++ | ++ | + |
| 81/82 | N400M | ++ | +++ | ++ | ++ | ++ |
| 83/84 | S315A | +++ | +++ | ++++ | ++ | + |
| 85/86 | S315A/Q389T/N453C | ++ | +++ | ++++ | + | + |
| 87/88 | F18H/H364M/N400M | ++ | + | ++ | + | ++ |
| 89/90 | F18H/M222T/N400M/R490T | ++ | ++++ | ++ | ++ | |
| 91/92 | Q389T/N400M | ++ | +++ | +++ | ++ | |
| 93/94 | F18H/Q389T/R490T | +++ | +++ | +++ | ++ | + |
| 95/96 | I77M/M222T/Q389T | ++ | ++++ | +++ | +++ | |
| 97/98 | F18H/Q389T/N400M/R490T | +++ | +++ | +++ | ++ | + |
| 99/100 | F18H/H364M/N453C | ++ | + | +++ | + | ++ |
| 101/102 | N400M/N453C | ++ | +++ | +++ | ++ | ++ |
| 103/104 | S315A/H364M | +++ | ++ | ++++ | + | ++ |
| 105/106 | F18H/M222T/H364M/N400M | + | +++ | +++ | + | + |

[1]Levels of increased activity were determined relative to the reference polypeptide of SEQ ID NO: 28, and defined as follows: ""+"" = .9 to 1.1; ""++"" > 1.25; and ""+++"" > 1.5.

Example 4

TAL Variants of SEQ ID NO: 92

In this Example, experiments for evolution and screening of TAL variants derived from SEQ ID NO: 92 for improved tyrosine activity and protease stability are described. Directed evolution of the TAL encoded by SEQ ID NO: 92 was carried out by constructing libraries of variant genes. These libraries were then plated, grown, and screened using the methods described below.

HTP-Analysis of Clarified Lysates:

HTP growth and lysis of E. coli cells expressing TAL variants were performed as described in Example 3. TAL variant activity on tyrosine and phenylalanine were assayed as described in Example 3, with the exception that the HTP lysate was diluted 4-fold in prior to assay with phenylalanine. The results of these assays are shown in Table 4-1. SEQ ID NO: 308 was selected for further directed evolution.

HTP-Analysis of Clarified Lysates Pretreated with Protease:

TAL variants were challenged with chymotrypsin and trypsin to simulate the environment of the intestine. First, 50 μL of protease mix (2 mg/mL chymotrypsin (Sigma Aldrich), 2 mg/mL trypsin (Sigma Aldrich)) in 200 mM sodium phosphate pH 7.0 and 50 μL of heat-treated clarified lysate were added to a 96-well round bottom plate (Costar). The plates were sealed and incubated for 1 hour at 37° C. in a Thermotron® titre-plate shaker (400 rpm) prior to analysis. Residual activity was determined by adding 40 μL of the protease-treated lysate to 160 μL of 200 mM sodium phosphate, 2.5 mM tyrosine, pH 7.0 in a 96-well UV-Star® plate (Greiner Bio-One). The reactions were mixed briefly, and activity was determined as described in Example 3. The results of this assay are shown in Table 4-1.

TABLE 4-1

Relative Activity of TAL Variants on Tyrosine and Phenylalanine
under various conditions (Relative to SEQ ID NO: 92)[1]

| SEQ ID NO: (nt/aa) | Amino Acid Differences (Relative to SEQ ID NO: 92) | 2 mM tyr | 0.1 mM tyr | Protease | 4 h tyr | 2 mM phe | 0.1 mM phe | 4 h phe |
|---|---|---|---|---|---|---|---|---|
| 107/108 | C424T/Y435L | + | ++ | ++ | + | + | ++ | + |
| 109/110 | M247L | ++ | +++ | ++ | ++ | +++ | ++++ | ++ |
| 111/112 | N114K/K145Q/M247L | + | +++ | + | + | +++ | ++++ | + |
| 113/114 | N258Q/V344A | ++ | ++ | | + | +++ | + | + |
| 115/116 | N114K/R204E/P275T/G425A | + | + | + | + | + | + | + |
| 117/118 | N114K/R204E/V344A | ++ | +++ | + | ++ | ++++ | +++ | + |
| 119/120 | R204E/M247L/V518I | + | ++ | | + | + | + | + |
| 121/122 | Y176H/R204E | + | ++ | ++ | + | | ++ | + |
| 123/124 | N114K/V518I | ++ | +++ | + | + | ++ | +++ | + |
| 125/126 | N114K/R204E/V518I | ++ | ++ | + | + | + | ++ | + |
| 127/128 | C424T | + | ++ | ++ | + | + | ++ | + |
| 129/130 | N114K/N258Q/P275T | +++ | +++ | ++ | ++ | +++ | +++ | ++ |
| 131/132 | V344A/C424T/Y435L/V518I | + | | + | + | + | | + |
| 133/134 | Y435L/V518I | + | + | + | + | + | + | + |
| 135/136 | V344A | +++ | ++++ | + | ++ | ++++ | +++ | + |
| 137/138 | Y176H/M247L/N258Q | + | ++ | + | + | + | ++ | + |
| 139/140 | Y176H/M247L | + | ++ | | + | | + | + |
| 141/142 | N114K/Y176H/V518I | + | +++ | ++ | + | | + | + |
| 143/144 | N114K/R204E/Y435L | ++ | ++++ | +++ | ++ | +++ | +++ | + |
| 145/146 | N114K/R204E | ++ | ++++ | ++ | ++ | +++ | ++++ | + |
| 147/148 | N114K/R204E/M247L/N258Q | + | ++ | + | + | ++ | ++ | + |
| 149/150 | Y176H/R204E/V518I | + | | + | | | + | + |

TABLE 4-1-continued

Relative Activity of TAL Variants on Tyrosine and Phenylalanine under various conditions (Relative to SEQ ID NO: 92)[1]

| SEQ ID NO: (nt/aa) | Amino Acid Differences (Relative to SEQ ID NO: 92) | 2 mM tyr | 0.1 mM tyr | Protease | 4 h tyr | 2 mM phe | 0.1 mM phe | 4 h phe |
|---|---|---|---|---|---|---|---|---|
| 151/152 | M247L/N258Q | ++ | + | + | + | +++ | ++ | + |
| 153/154 | N114K/R204E/P266Q/G425A | + | + |  |  | + | + | + |
| 155/156 | M247L/P275T/V344A/V518I | ++ | + | + | + | +++ | + | + |
| 157/158 | K145Q/C424T/Y435L | + |  | + |  | + |  | + |
| 159/160 | R204E/P275T/V344A | +++ | ++ | + | + | +++ | + | + |
| 161/162 | R204E/N258Q/P275T | + |  |  |  | + |  | + |
| 163/164 | N114K/K145Q/R204E/P275T/C424T/Y435L | + | + | + |  |  |  | + |
| 165/166 | N114K/R204E/P275T/V518I | + | + | + |  | + | + | + |
| 167/168 | P275T/V344A | +++ | + | + | + | +++ | + | + |
| 169/170 | R204E/M247L/Y435L | ++ | ++ | + | + | ++ | ++ | + |
| 171/172 | M247L/C424T/Y435L | + | + | + |  | + | + | + |
| 173/174 | V518I | ++ | ++ | ++ | + | +++ | +++ | + |
| 175/176 | Y176H/N258Q/V518I | + |  | + |  |  |  |  |
| 177/178 | K145Q/N258Q/P275T/V518I | + |  | + | + | + |  | + |
| 179/180 | N114K/N258Q/C424T/G425A/V518I | + | + | + | + | + |  | + |
| 181/182 | K145Q/R204E/P275T/Y435L | + |  | + | + | + | + | + |
| 183/184 | M247L/N258Q/V518I | + |  | + | + | + |  | + |
| 185/186 | N114K/M247L/P275T/V344A/V518I | + | + |  | + | +++ | + | + |
| 187/188 | N114K/R204E/Y435L/V518I | + | + | + | + |  |  | + |
| 189/190 | Y176H/P275T | + | ++ | +++ | + |  | ++ | + |
| 191/192 | S49R/N114K/R204E/G425A | + | + | + | + | + | ++ | + |
| 193/194 | N114K | +++ | +++ | ++ | + | ++++ | ++++ | ++ |
| 195/196 | K145Q/Y435L | + | + | + |  | + | + | + |
| 197/198 | Y176H/V518I | + |  | + |  |  | + | + |
| 199/200 | N114K/K145Q/P275T/V344A/C424T/Y435L | ++ | + | + | + | +++ | + | + |
| 201/202 | N258Q/Y435L | +++ | + | ++ | + | ++++ | + | + |
| 203/204 | N114K/Y176H | + |  | ++ |  | + | + | + |
| 205/206 | R204E/V518I | + | + | + | + | ++ | + | + |
| 207/208 | R204E/M247L/N258Q/P275T | +++ | + | + | + | +++ | + | + |
| 209/210 | M247L/V518I | ++ | + |  | + | +++ | + | + |
| 211/212 | Y435L | +++ | + | +++ | + | +++ | + | + |
| 213/214 | N114K/K145Q/P275T | ++ | ++ | + | + | +++ | ++ | + |
| 215/216 | N114K/K145Q/R204E/N258Q/P275T | ++ | + | + | + | ++ | + | + |
| 217/218 | R204E | +++ | +++ | +++ | + | ++++ | +++ | ++ |
| 219/220 | N114K/R204E/N258Q/C424T/Y435L | ++ | + | +++ | + | ++ | + | + |
| 221/222 | P275T | +++ | +++ | ++ | + | +++ | +++ | ++ |
| 223/224 | Q214L | ++ | + |  | + | + |  |  |
| 225/226 | K413T |  |  |  | + |  |  |  |
| 227/228 | S395A | + |  |  | + | + |  |  |
| 229/230 | G307A | ++ | + |  | + | ++++ |  |  |
| 231/232 | L104M | + |  | + |  |  |  |  |
| 233/234 | Y378H/V407L | ++ | + | + | + | +++ |  |  |
| 235/236 | K73N | ++ | ++ |  | + | ++ |  |  |
| 237/238 | T345C |  |  | ++ |  |  |  |  |
| 239/240 | R410V/H517N | + | ++ | + | + |  |  |  |
| 241/242 | L464M | ++ | + | ++ | + | ++ |  |  |
| 243/244 | F450Y | + | + | + | + | ++ |  |  |
| 245/246 | R410F |  |  | + | + |  |  |  |
| 247/248 | W106H | + |  |  | + | ++ |  |  |
| 249/250 | K413P |  |  | + | + |  |  |  |
| 251/252 | D306P |  |  | ++ | + |  |  |  |
| 253/254 | V407L |  |  |  | + |  |  |  |
| 255/256 | S175G | + | + | ++ | + |  |  |  |
| 257/258 | Q214A | + | + | ++ | + | ++ |  |  |
| 259/260 | L418M | + |  |  | + |  |  |  |
| 261/262 | R410V | + |  | ++ | + |  |  |  |
| 263/264 | A112V |  | + | ++ |  |  |  |  |
| 265/266 | Q214H | + |  |  |  | + |  |  |
| 267/268 | Q61P | + | + | + |  | ++ |  |  |
| 269/270 | R410P | ++ | + | ++ | + | ++ |  |  |
| 271/272 | S98K |  |  |  |  |  |  |  |
| 273/274 | K413T/Q557K | + |  | + |  | + |  |  |
| 275/276 | K73A | + |  |  |  | + |  |  |
| 277/278 | A112N |  |  | ++ |  | + |  |  |
| 279/280 | S98G |  |  |  |  |  |  |  |
| 281/282 | E72A/D306G/G307E |  |  |  | + |  |  |  |
| 283/284 | A394T/K413P | + | + | + | + | + |  |  |
| 285/286 | D306G | + | ++ |  | + | ++ |  |  |
| 287/288 | A119S/P404A/R410S | ++ | +++ | + | ++ | ++ |  |  |
| 289/290 | S98K/P404A/R410S | + | + | + |  |  |  |  |
| 291/292 | R43S/R410S/K413P |  |  |  |  |  |  |  |
| 293/294 | D306G/G307E/A394T/P404A/R410S | ++ | ++ |  | + | ++ |  |  |
| 295/296 | D306G/G307E/L309P |  |  |  | + |  |  |  |
| 297/298 | E72A | + | + |  | + | + |  |  |

TABLE 4-1-continued

Relative Activity of TAL Variants on Tyrosine and Phenylalanine under various conditions (Relative to SEQ ID NO: 92)[1]

| SEQ ID NO: (nt/aa) | Amino Acid Differences (Relative to SEQ ID NO: 92) | 2 mM tyr | 0.1 mM tyr | Protease | 4 h tyr | 2 mM phe | 0.1 mM phe | 4 h phe |
|---|---|---|---|---|---|---|---|---|
| 299/300 | D306G/G307E/A394T | + | | | + | + | | |
| 301/302 | T110V | | | | | | + | |
| 303/304 | E72A/D306G/L309P | + | + | | | + | + | |
| 305/306 | D306G/R410S | ++ | +++ | | | ++ | +++ | |
| 307/308 | R410S | ++ | ++ | ++ | | + | + | |
| 309/310 | A394T/R410S | + | ++ | ++ | | + | + | |

[1]Levels of increased activity were determined relative to the reference polypeptide of SEQ ID NO: 92, and defined as follows: ""+"" = .9 to 1.1; ""++"" > 1.25; and ""+++"" > 1.5.

Example 5

TAL Variants of SEQ ID NO: 308

In this Example, experiments for evolution and screening of TAL variants derived from SEQ ID NO: 308 for improved tyrosine activity and protease stability are described. Directed evolution of the TAL encoded by SEQ ID NO: 308 was carried out by constructing libraries of variant genes. These libraries were then plated, grown, and screened using the methods described below.

HTP-Analysis of Clarified Lysates:

HTP growth and lysis of *E. coli* cells expressing TAL variants were performed as described in Example 3. TAL variant activity on tyrosine and phenylalanine were assayed as described in Example 3, with the exception that the HTP lysate was diluted 2-fold in water prior to assay with 2 mM tyrosine and 4-fold in water prior to assay with 2 mM phenylalanine. The results of these assays are shown in Table 5-1.

HTP-Analysis of Clarified Lysates Pretreated with Protease:

TAL variants were challenged with chymotrypsin and trypsin as described in Example 4, and residual activity on tyrosine was measured as described in Example 4. The results of this assay are shown in Table 5-1.

TABLE 5-1

Relative Activity of TAL Variants on Tyrosine and Phenylalanine Under Various Conditions (Relative to SEQ ID NO: 308)[1]

| SEQ ID NO: (nt/aa) | Amino Acid Differences (Relative to SEQ ID NO: 308) | 2 mM tyr | 0.1 mM tyr | Protease | 2 mM phe |
|---|---|---|---|---|---|
| 311/312 | A394T/L464M | + | | + | + |
| 313/314 | A394T/S410P/L464M | + | + | ++ | + |
| 315/316 | Q214A/S410P/F450Y/L464M | + | | + | + |
| 317/318 | Q61P/Q214A/L464M | + | + | + | |
| 319/320 | Q61P | + | + | ++ | + |
| 321/322 | Q214A | + | + | + | + |
| 323/324 | N114K/S410V/K413P/L418M | + | + | + | |
| 325/326 | N114K/A119S | + | + | + | + |
| 327/328 | S410V/L418M/F450Y/L464M | + | + | +++ | |
| 329/330 | L464M | + | + | ++ | + |
| 331/332 | L418M | + | + | ++ | + |
| 333/334 | S513E/N534D | + | + | +++ | + |
| 335/336 | A119E/Y237H/I254L/S513E | + | + | ++ | + |
| 337/338 | Y237H/I254L/S331E | + | + | ++ | + |
| 339/340 | A119E/K145Q/Y237H/S331E | ++ | + | ++ | ++ |
| 341/342 | Y237H | + | + | + | + |
| 343/344 | Y158V/N534D | + | + | | |
| 345/346 | Y237H/S513E | + | | + | ++ |
| 347/348 | E509L/S513E | ++ | + | ++ | ++ |
| 349/350 | A119E/S331E/E509L/S513E | ++ | ++ | + | ++ |
| 351/352 | K145Q/Y237H/E509L/S513E/N534D | + | + | +++ | + |
| 353/354 | A119E/E509L/S513E | ++ | ++ | + | ++ |
| 355/356 | Y237H/E509L/S513E | ++ | + | + | + |
| 357/358 | K32D/A119E/Y237H/S513E/N534D | ++ | ++ | + | ++ |
| 359/360 | Y158V/E509L/S513E/N534D | ++ | ++ | + | + |
| 361/362 | K32D/A119E/E509L/S513E/N534D | ++ | ++ | + | + |
| 363/364 | E509L/S513E/N534D | + | + | ++ | + |
| 365/366 | Y237H/S513E/N534D | + | + | ++ | + |
| 367/368 | N114G | + | + | + | + |
| 369/370 | K522A | + | + | + | + |
| 371/372 | Y237M | ++ | + | + | + |
| 373/374 | A551Q | + | + | ++ | + |
| 375/376 | S286G | + | + | ++ | + |
| 377/378 | Q355K | ++ | ++ | ++++ | ++ |
| 379/380 | H497G | ++ | ++ | +++ | + |
| 381/382 | A547H | ++ | + | ++++ | ++ |
| 383/384 | K54P | +++ | ++ | ++++ | ++ |
| 385/386 | S525G | ++ | + | ++++ | ++ |
| 387/388 | D353L | + | + | ++++ | + |
| 389/390 | I27G | ++ | ++ | ++++ | + |
| 391/392 | S331G | ++ | ++ | ++++ | + |
| 393/394 | A551E | ++ | ++ | ++++ | ++ |
| 395/396 | D282G | + | + | ++++ | + |
| 397/398 | A502S | ++ | ++ | ++++ | + |
| 399/400 | S331E | ++ | +++ | ++++ | ++ |
| 401/402 | E338D | + | + | ++++ | + |
| 403/404 | S331P | ++ | ++ | ++++ | ++ |
| 405/406 | Q355R | + | + | ++ | + |
| 407/408 | S331H | + | + | ++++ | + |
| 409/410 | V249A/I339L | ++ | +++ | ++++ | + |
| 411/412 | A289E/H517Q | + | + | +++ | + |
| 413/414 | Q560R | + | + | +++ | + |
| 415/416 | P209V | + | ++ | +++ | + |
| 417/418 | I56P | +++ | + | + | ++ |
| 419/420 | N193L | +++ | + | ++ | ++ |
| 421/422 | H517G | +++ | + | ++ | ++ |
| 423/424 | K189T | +++ | + | ++ | + |
| 425/426 | Y237R | ++++ | + | +++ | +++ |
| 427/428 | P209G | +++ | + | ++ | ++ |
| 429/430 | A502G | +++ | + | ++ | ++ |
| 431/432 | P266T | +++ | + | + | + |
| 433/434 | Q61S | +++ | + | + | + |
| 435/436 | N36A | +++ | + | ++ | ++ |
| 437/438 | Q560S | +++ | + | ++ | ++ |
| 439/440 | H497M | +++ | + | + | + |
| 441/442 | I339T | +++ | + | +++ | + |

TABLE 5-1-continued

Relative Activity of TAL Variants on Tyrosine and Phenylalanine Under Various Conditions (Relative to SEQ ID NO: 308)[1]

| SEQ ID NO: (nt/aa) | Amino Acid Differences (Relative to SEQ ID NO: 308) | 2 mM tyr | 0.1 mM tyr | Protease | 2 mM phe |
|---|---|---|---|---|---|
| 443/444 | I339C | +++ | ++ | ++ | + |
| 445/446 | S524T | +++ | + | + | + |
| 447/448 | K522P | + | +++ | + | + |
| 449/450 | N68F | ++ | ++++ | + | |
| 451/452 | D282E | + | +++ | + | + |
| 453/454 | V554Q | + | +++ | ++ | + |
| 455/456 | N270E/N532D | + | +++ | + | + |
| 457/458 | Y237F | ++ | ++ | ++ | + |
| 459/460 | N69D | + | ++ | +++ | + |
| 461/462 | S524V | + | + | ++ | + |
| 463/464 | N36E | ++ | ++ | +++ | + |
| 465/466 | A289Q | ++ | + | +++ | + |
| 467/468 | K54T | + | + | +++ | + |
| 469/470 | A502D | + | + | ++ | + |
| 471/472 | A551C | + | + | ++ | + |
| 473/474 | L118T | ++ | ++ | + | + |
| 475/476 | A547D | ++ | ++ | +++ | + |
| 477/478 | A551T | ++ | + | ++ | + |
| 479/480 | Q560E | ++ | + | ++ | + |
| 481/482 | Q58A | + | + | +++ | + |
| 483/484 | K522G | + | + | ++ | + |
| 485/486 | Q31D | +++ | ++ | ++ | ++ |
| 487/488 | N270T | + | + | + | + |
| 489/490 | N354V | ++ | + | ++ | |
| 491/492 | R467G | + | ++ | + | + |
| 493/494 | K335G | ++ | ++ | +++ | ++ |
| 495/496 | E470G | ++ | ++ | ++ | + |
| 497/498 | I27D | ++ | ++ | ++ | + |

[1]Levels of increased activity were determined relative to the reference polypeptide of SEQ ID NO: 308, and defined as follows: """+"""" = .9 to 1.1; """++"""" > 1.25; and """+++"""" > 1.5.

Example 6

TAL Variants of SEQ ID NO: 338

In this Example, experiments for evolution and screening of TAL variants derived from SEQ ID NO: 338 for improved tyrosine activity, protease resistance, and low pH tolerance are described. Directed evolution of the TAL encoded by SEQ ID NO: 338 was carried out by constructing libraries of variant genes. These libraries were then plated, grown, and screened using the methods described below.

HTP Activity Analysis of Clarified Lysates and Clarified Lysates Pretreated with Protease and/or Acidic Buffer:

HTP growth and lysis of *E. coli* cells expressing TAL variants were performed as described in Example 3, with the exception that clarified lysates were preincubated for 2 h at 65° C. in a THEMATRON® titre-plate shaker (400 rpm) before being centrifuged (4000 rpm×10 min). The activity of the TAL variants' on tyrosine and phenylalanine were assayed as described in Example 5. TAL variants were challenged with chymotrypsin and trypsin as described in Example 4, and residual activity on tyrosine was measured as described in Example 4. The results of these assays are shown in Tables 6-1 and 6-2. SEQ ID NO: 504 was selected for further directed evolution.

In additional experiments, TAL variants were challenged with acidic buffer to simulate the gastric environment. First, 50 µL of McIlvaine buffer pH 5 or pH 4.2 and 50 µL of heat-treated clarified lysate were added to a 96-well round bottom plate (Costar). The plates were sealed and incubated for 1 hour at 37° C. in a THERMOTRON® titre-plate shaker (400 rpm) prior to analysis. After incubation, the lysate solutions were briefly centrifuged, and residual activity determined by adding 40 µL of the acidic buffer-treated lysate to 160 µL of 200 mM sodium phosphate, 2.5 mM tyrosine, pH 7.0, in a 96-well UV-STAR® plate (Greiner Bio-One). The reactions were mixed briefly, and activity on tyrosine was determined as described in Example 4. The results of this assay are shown in Tables 6-1 and 6-2.

TABLE 6-1

Relative Activity of TAL Variants on Tyrosine and Phenylalanine under various conditions (Relative to SEQ ID NO: 338)[1]

| SEQ ID NO: (nt/aa) | Amino Acid Differences (Relative to SEQ ID NO: 338) | 2 mM tyr FIOPC | 0.1 mM tyr FIOPC | Protease FIOPC | pH 5 FIOPC | 2 mM phe |
|---|---|---|---|---|---|---|
| 499/500 | K335G/S410P | ++ | ++ | ++ | ++ | ++ |
| 501/502 | K54P/H237M | ++ | + | + | ++ | ++ |
| 503/504 | Q31D/K335G | +++ | ++ | ++ | +++ | +++ |
| 505/506 | H237M/H517G | + | + | + | + | + |
| 507/508 | Q31D/H237R/K335G | +++ | ++ | ++ | ++ | +++ |
| 509/510 | K54P/K335G/Q355K/S410P/A502G | ++ | + | ++ | ++ | ++ |
| 511/512 | D282E/A502G | + | + | + | + | + |
| 513/514 | H237M/S410P/A502G | + | + | + | + | + |
| 515/516 | Q31D/K54P/H237M/D282E | ++ | ++ | ++ | ++ | +++ |
| 517/518 | Q31D/S410P | ++ | + | + | ++ | ++ |
| 519/520 | I27G/D282E/S410P | ++ | ++ | ++ | + | + |
| 521/522 | Q31D/N534D/A547D | +++ | +++ | ++ | ++ | ++ |
| 523/524 | D282E/S410P | + | + | + | ++ | + |
| 525/526 | D282E/S410P/A502G/H517G/A547D | + | + | + | + | + |
| 527/528 | H237R/D282E/S410P/A502G | + | + | + | + | + |
| 529/530 | K54P/H237R | ++ | ++ | ++ | ++ | ++ |
| 531/532 | A502G | + | + | + | + | + |
| 533/534 | Q31D/K54P/D282E/K335G/A502G | ++ | ++ | ++ | ++ | ++ |
| 535/536 | I27G/Q31D/A502G/N534D | + | + | ++ | + | |
| 537/538 | Q31D/K54P | ++ | + | + | ++ | +++ |
| 539/540 | S410P/A547D | ++ | ++ | ++ | ++ | ++ |
| 541/542 | I27G/Q31D/K54P | + | ++ | ++ | + | ++ |
| 543/544 | Q31D/D282E | + | ++ | + | ++ | ++ |
| 545/546 | Q31D/A502G | ++ | ++ | + | ++ | ++ |
| 547/548 | Q31D/H237M/K335G/A502G | ++ | ++ | + | ++ | ++ |
| 549/550 | A119E/V554Q | ++ | + | ++ | + | + |
| 551/552 | A119E/A551Q/V554Q | ++ | + | ++ | + | + |

TABLE 6-1-continued

Relative Activity of TAL Variants on Tyrosine and Phenylalanine under various conditions (Relative to SEQ ID NO: 338)[1]

| SEQ ID NO: (nt/aa) | Amino Acid Differences (Relative to SEQ ID NO: 338) | 2 mM tyr FIOPC | 0.1 mM tyr FIOPC | Protease FIOPC | pH 5 FIOPC | 2 mM phe |
|---|---|---|---|---|---|---|
| 553/554 | N114G | + | + | + | + | + |
| 555/556 | V554Q | + | + | + | + | + |
| 557/558 | N36A/N114G/A119E/A289Q/V554Q | + | + | ++ | + | |
| 559/560 | N114G/A119E/V554Q | ++ | ++ | ++ | + | + |
| 561/562 | A119E/L418M/A551Q/V554Q | + | + | + | + | + |
| 563/564 | Q61P/A119E/I339T/A551Q/V554Q | + | + | + | + | + |
| 565/566 | A119E/I339T/V554Q | ++ | + | ++ | + | + |
| 567/568 | L254I/L418M | + | + | + | + | ++ |
| 569/570 | A119E/L254I/S286G/I339T/H364M/L418M/A551Q | +++ | + | +++ | ++ | +++ |
| 571/572 | N114G/S286G/I339T/L418M | + | + | + | + | |
| 573/574 | L254I/S286G/A289Q/V554Q | ++ | ++ | + | ++ | ++ |
| 575/576 | N114G/A119E/L254I/A289Q/A551Q | + | + | ++ | + | ++ |
| 577/578 | A119E/L254I/A289Q/V554Q | ++ | ++ | + | ++ | ++ |
| 579/580 | A289Q | + | + | + | + | + |
| 581/582 | I339T/L418M/A551Q | + | + | + | + | + |
| 583/584 | L254I/A289Q/I339T/L418M/V554Q | + | + | ++ | + | + |
| 585/586 | N114G/H364M/V554Q | ++ | + | +++ | ++ | +++ |
| 587/588 | S286G/A289Q | + | + | + | + | + |
| 589/590 | A119E/I339T/H364M/L418M/A551Q | +++ | + | +++ | ++ | +++ |
| 591/592 | N114G/A119E/I339T/H364M | ++ | + | +++ | + | ++ |
| 593/594 | Q61P/N114G/A119E/S286G/A289Q/A551Q/V554Q | + | + | + | + | |
| 595/596 | N114G/A119E/L254I/A289Q | + | + | + | + | + |
| 597/598 | A289Q/A551Q | + | + | + | + | + |
| 599/600 | L254I | ++ | + | + | + | ++ |
| 601/602 | S286G/A289Q/L418M/V554Q | + | + | + | + | + |

[1]Levels of increased activity were determined relative to the reference polypeptide of SEQ ID NO: 338, and defined as follows: "+" >0.9; "++" >1.1; and "+++" >1.25.

TABLE 6-2

Relative Activity of TAL Variants on Tyrosine and Phenylalanine under various conditions (Relative to SEQ ID NO: 338)[1]

| SEQ ID NO: (nt/aa) | Amino Acid Differences (Relative to SEQ ID NO: 338) | 2 mM tyr FIOPC | 0.1 mM tyr FIOPC | Protease FIOPC | pH 4.2 FIOPC | 2 mM phe FIOPC |
|---|---|---|---|---|---|---|
| 603/604 | Y158H | + | ++ | + | + | + |
| 605/606 | I478V | + | + | + | + | ++ |
| 607/608 | T463F | + | + | ++ | + | + |
| 609/610 | N474T | + | + | + | + | |
| 611/612 | I478L | + | + | ++ | + | + |
| 613/614 | M133T | + | + | | + | + |
| 615/616 | N474F | + | | | | |
| 617/618 | I439L | + | + | + | + | + |
| 619/620 | F267Y | + | + | + | | |
| 621/622 | Y158Q | + | + | ++ | + | + |
| 623/624 | Y367A | + | | + | + | + |
| 625/626 | I530L | + | + | ++ | + | + |
| 627/628 | N474R | + | + | + | + | + |
| 629/630 | F162H | + | + | | + | ++ |
| 631/632 | S343A | + | ++ | + | | + |
| 633/634 | M481L | + | | + | + | |
| 635/636 | N130C | + | | ++ | + | |
| 637/638 | Y367C | + | + | + | | + |
| 639/640 | Y158L | + | ++ | + | + | + |
| 641/642 | Y367S | + | | | | + |
| 643/644 | Y158I | + | +++ | + | + | + |
| 645/646 | H541M | + | + | + | + | + |
| 647/648 | P403T | + | + | + | + | |
| 649/650 | T463L | + | + | ++ | | + |
| 651/652 | F162Y | + | ++ | + | + | + |
| 653/654 | I530V | + | + | ++ | + | + |
| 655/656 | T463E | ++ | ++ | +++ | +++ | ++ |
| 657/658 | N474G | + | + | + | + | |
| 659/660 | L319A | + | + | + | + | + |
| 661/662 | N474S | + | + | + | + | + |
| 663/664 | I390V | + | + | + | + | + |
| 665/666 | L116M | | + | | | |
| 667/668 | A479G | + | + | + | ++ | + |
| 669/670 | N474C; | | | + | + | |
| 671/672 | L211V | + | + | + | + | + |
| 673/674 | Q366E | | + | + | + | |
| 675/676 | A440S | + | + | | + | + |
| 677/678 | A136Q | | + | + | + | |
| 679/680 | N474E | + | + | ++ | + | + |
| 681/682 | T463N | + | ++ | ++ | ++ | ++ |
| 683/684 | T463G | + | ++ | ++ | +++ | ++ |
| 685/686 | L386V | + | | | + | + |
| 687/688 | P444A | | + | + | | |
| 689/690 | A479S | + | + | + | + | + |
| 691/692 | N474H | + | + | ++ | + | + |
| 693/694 | G369S | | | + | | |
| 695/696 | Y158S | + | + | + | + | + |
| 697/698 | Y158W | + | + | | + | + |
| 699/700 | L116V | + | + | + | + | ++ |
| 701/702 | F443Y | + | + | + | + | + |
| 703/704 | A462S | + | + | ++ | ++ | + |
| 705/706 | T463M | + | | ++ | + | ++ |
| 707/708 | I478A | | | | + | + |
| 709/710 | I428M | + | + | + | + | + |
| 711/712 | A477S | + | + | + | | + |
| 713/714 | A251S | | | + | | |
| 715/716 | A280V | | | | + | + |
| 717/718 | A356H | + | | + | + | + |

[1]Levels of increased activity were determined relative to the reference polypeptide of SEQ ID NO: 338, and defined as follows: "+" > 0.9; "++" >1.1; and "+++" >1.25.

Example 7

TAL Variants of SEQ ID NO: 504

In this Example, experiments for evolution and screening of TAL variants derived from SEQ ID NO: 504 for improved tyrosine activity, protease resistance, and low pH tolerance are described. Directed evolution of the TAL encoded by SEQ ID NO: 504 was carried out by constructing libraries of variant genes. These libraries were then plated, grown, and screened using the methods described below.

HTP Activity Analysis of Clarified Lysates and Clarified Lysates Pretreated with Protease and/or Acidic Buffer:

HTP growth and lysis of *E. coli* cells expressing TAL variants were performed as described in Example 6. TAL variant activity on tyrosine and phenylalanine were assayed as described in Example 5, with the exception that the HTP lysate was diluted 8-fold in water prior to assay with phenylalanine. TAL variants were challenged with chymotrypsin and trypsin as described in Example 4, with the exception that 50 μL of heat-treated clarified lysate was incubated with 50 μL of protease mix consisting of 3 mg/mL chymotrypsin (Sigma Aldrich) and 3 mg/mL trypsin (Sigma Aldrich) in 200 mM sodium phosphate pH 7.0 for 1 hour at 37° C. The residual activity on tyrosine was measured as described in Example 4. The results of these assays are shown in Table 7-1. SEQ ID NO: 736 was selected for further directed evolution.

TAL variants were challenged with acidic buffer as described in Example 6, with the exception that 50 μL of heat-treated clarified lysate was incubated with 50 μL of McIlvaine buffer, pH 4.2, for 1 hour at 37° C. Activity on tyrosine was determined as described in Example 4, and the results of this assay are shown in Table 7-1.

TABLE 7-1

Relative Activity of TAL Variants on Tyrosine and Phenylalanine under various conditions (Relative to SEQ ID NO: 504)[1]

| SEQ ID NO: (nt/aa) | Amino Acid Differences (Relative to SEQ ID NO: 504) | 2 mM tyr FIOPC | 0.1 mM tyr FIOPC | Protease FIOPC | pH 4.2 FIOPC | 2 mM phe FIOPC |
|---|---|---|---|---|---|---|
| 719/720 | K54P/A119E/F162Y/H364M/S410P | ++ | | +++ | ++++ | ++ |
| 721/722 | K54P/A462S | + | + | ++ | + | + |
| 723/724 | K54P/H364M/P403T | ++ | | ++ | ++++ | ++ |
| 725/726 | K54P/L116V/A119E/H364M | ++ | | +++ | ++++ | ++ |
| 727/728 | K54P/T463E | + | ++ | ++ | +++ | + |
| 729/730 | A119E/F162Y | ++ | + | + | +++ | + |
| 731/732 | N474E | + | + | | + | + |
| 733/734 | K54P/I530V | + | + | ++ | ++ | |
| 735/736 | K54P/S410P/T463E | + | + | ++ | +++ | + |
| 737/738 | L116V/F162Y/H364M | ++ | | ++ | ++++ | ++ |
| 739/740 | A119E/F162Y/S410P | ++ | + | + | +++ | + |
| 741/742 | A462S | + | + | ++ | + | + |
| 743/744 | K54P | + | + | + | ++ | + |
| 745/746 | S410P | + | + | | ++ | + |

[1]Levels of increased activity were determined relative to the reference polypeptide of SEQ ID NO: 504, and defined as follows: "+" >0.9; "++" >1.1; "+++" >1.5; and "++++" >2

Example 8

TAL Variants of SEQ ID NO: 736

In this Example, experiments for evolution and screening of TAL variants derived from SEQ ID NO: 736 for improved tyrosine activity, protease resistance, and low pH tolerance are described. Directed evolution of the TAL encoded by SEQ ID NO: 736 was carried out by constructing libraries of variant genes. These libraries were then plated, grown, and screened using the methods described below.

HTP Activity Analysis of Clarified Lysates and Clarified Lysates Pretreated with Protease and/or Acidic Buffer:

HTP growth and lysis of *E. coli* cells expressing TAL variants were performed as described in Example 6. TAL variant activity on tyrosine and phenylalanine were assayed as described in Example 5, with the exception that the HTP lysate was diluted 5-fold in water prior to assay with phenylalanine. TAL variants were challenged with chymotrypsin and trypsin as described in Example 7, and the residual activity on tyrosine was measured as described in Example 4. The results of these assays are shown in Table 8-1.

TAL variants were challenged with acidic buffer as described in Example 6, with the exception that 50 μL of heat-treated clarified lysate was incubated with 50 μL of McIlvaine buffer pH 4.4 for 1 hour at 37° C. Activity on tyrosine was determined as described in Example 4, and the results of this assay are shown in Table 8-1.

TABLE 8-1

Relative Activity of TAL Variants on Tyrosine and Phenylalanine under various conditions (Relative to SEQ ID NO: 736)[1]

| SEQ ID NO: (nt/aa) | Amino Acid Differences (Relative to SEQ ID NO: 736) | 2 mM tyr FIOPC | 0.1 mM tyr FIOPC | Protease FIOPC | pH 4.4 FIOPC | 2 mM phe FIOPC |
|---|---|---|---|---|---|---|
| 747/748 | F18H/A289Q/I339T/H364M/V554Q | ++ | | ++ | + | ++ |
| 749/750 | F18H/I339T/N534D | + | + | + | + | + |
| 751/752 | F18H/L254I | ++ | ++ | | ++ | +++ |
| 753/754 | F18H/A289Q/N534D/V554Q | ++ | ++ | + | + | ++ |
| 755/756 | A289Q/N534D/V554Q | + | + | + | + | + |
| 757/758 | F18H/N52D/E463T | ++ | ++ | | ++ | ++ |
| 759/760 | N534D/A551Q/V554Q | + | + | + | + | + |
| 761/762 | F18H | ++ | ++ | + | ++ | ++ |
| 763/764 | L254I/A289Q/I339T/L418M/E463T/V554Q | ++ | ++ | | ++ | ++ |
| 765/766 | N534D | + | + | + | + | + |
| 767/768 | F18H/I339T/L418M/E463T | ++ | + | | + | + |
| 769/770 | F18H/I339T/E463T | ++ | ++ | + | ++ | ++ |
| 771/772 | F18H/A289Q | ++ | ++ | + | ++ | ++ |
| 773/774 | A289Q/S315A/I339T/H364M/L418M/E463T/A551Q | ++ | | ++ | + | ++ |
| 775/776 | F18H/F267Y/V554Q | ++ | ++ | | ++ | ++ |
| 777/778 | I339T/H364M/E463T | ++ | + | ++ | ++ | +++ |
| 779/780 | F18H/A289Q/V554Q | ++ | ++ | | ++ | ++ |

[1]Levels of increased activity were determined relative to the reference polypeptide of SEQ ID NO: 736, and defined as follows: "+" >0.9; and "++" >1.1."

SEQUENCE LISTING (780 sequences)

SEQ ID NO: 1 - DNA, 1701 bp, Artificial Sequence
  Wild Type Phenylalanine Ammonia Lyase from Anabaena variabilis
atgaaaaccctgagccaggcacagagcaaaaccagcagccagcagtttagctttaccggcaatagcagcgcaaatgtgattattggtaatcagaaactgaccatcaatgatgttgcacgtgttgcccgtaatggcaccctggttagcctgaccaataataccgatattctgcagggtattcaggccagctgtgattatatcaataatgcagttgaaagcggtgaaccgatttatggtgttaccagcggttttggtggtatggcaaatgttgcaattagccgtgaacaggcaagcgaactgcagaccaatctggtttggtttctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgcgtcagctgaatctgagtccgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgattagcctgctggccaatagccagctggttcgtgatgaactggatggtaaacatgattatcgtgatcatgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttctgggtcagtatgttggtatgggtatggatcatctgcgctattatatcggtctgctggcaaaacatctggatgttcagattgcactgctggcatcaccggaatttagcaatggtctgcctccgagtctgctgggtaatcgtgaacgtaaagttaatatgggtctgaaaggtctgcagatttgcggtaatagcattatgccgctgctgaccttttatggtaatagtattgcagatcgttttccgacccatgccgaacagtttaaccagaatattaacagccagggttataccagcgcaaccctggcacgtcgtagcgttgatatttttcagaattatgttgccattgccctgatgtttggtgttcaggcagttgatctgcgtacctacaaaaaaaccggtcattatgatgcacgtgcctgtctgtcaccggcaaccgaacgtctgtatagcgcagttcgtcatgttgttggtcagaaaccgacctcagatcgtccgtatatttggaatgataatgaacagggtctggatgaacatattgcacgtattagtgcagatattgcagccggtggtgttattgttcaggccgttcaggacattctgccgtgtctgcat

SEQ ID NO: 2 - protein, 567 aa, Artificial Sequence
  Wild Type Phenylalanine Ammonia Lyase from Anabaena variabilis
MKTLSQAQSKTSSQQFSFTGNSSANVIIGNQKLTINDVARVARNGTLVSLTNNTDILQGIQASCDYINNAVESGEPIYGVTSGFGGMANVAISREQASELQTNLVWFLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLSPLTLLPKEGLAMMNGTSVMTGIAANCVYDTQILTAIAMGVHALDIQALNGTNQSFHPFIHNSKPHPGQLWAADQMISLLANSQLVRDELDGKHDYRDHELIQDRYSLRCLPQYLGPIVDGISQIAKQIEIEINSVTDNPLIDVDNQASYHGGNFLGQYVGMGMDHLRYYIGLLAKHLDVQIALLASPEFSNGLPPSLLGNRERKVNMGLKGLQICGNSIMPLLTFYGNSIADRFPTHAEQFNQNINSQGYTSATLARRSVDIFQNYVAIALMFGVQAVDLRTYKKTGHYDARACLSPATERLYSAVRHVVGQKPTSDRPYIWNDNEQGLDEHIARISADIAAGGVIVQAVQDILPCLH

SEQ ID NO: 3 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 4 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 5 - DNA, 1701 bp, Artificial Sequence
  Variant of Phenylalanine Ammonia Lyase from Anabaena variabilis
atgaaaaccctgagccaggcacagagcaaaaccagcagccagcagtttagctttaccggcaatagcagcgcaaatgtgattattggtaatcagaaactgaccatcaatgatgttgcacgtgttgcccgtaatggcaccctggttagcctgaccaataataccgatattctgcagggtattcaggccagctgtgattatatcaataatgcagttgaaagcggtgaaccgatttatggtgttaccagcggttttggtggtatggcaaatgttgcaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgcgtcagctgaatctgagtccgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgattagcctgctggccaatagccagctggttcgtgatgaactggatggtaaacatgattatcgtgatcatgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttctgggtcagtatgttggtatgggtatggatcatctgcgctattatatcggtctgctggcaaaacatctggatgttcagattgcactgctggcatcaccggaatttagcaatggtctgcctccgagtctgctgggtaatcgtgaacgtaaagttaatatgggtctgaaaggtctgcagatttgcggtaatagcattatgccgctgctgaccttttatggtaatagtattgcagatcgttttccgacccatgccgaacagtttaaccagaatattaacagccagggttataccagcgcaaccctggcacgtcgtagcgttgatatttttcagaattatgttgccattgccctgatgtttggtgttcaggcagttgatctgcgtacctacaaaaaaaccggtcattatgatgcacgtgcctgtctgtcaccggcaaccgaacgtctgtatagcgcagttcgtcatgttgttggtcagaaaccgacctcagatcgtccgtatatttggaatgataatgaacagggtctggatgaacatattgcacgtattagtgcagatattgcagccggtggtgttattgttcaggccgttcaggacattctgccgtgtctgcat

SEQ ID NO: 6 - protein, 567 aa, Artificial Sequence
  Variant of Phenylalanine Ammonia Lyase from Anabaena variabilis
MKTLSQAQSKTSSQQFSFTGNSSANVIIGNQKLTINDVARVARNGTLVSLTNNTDILQGIQASCDYINNAVESGEPIYGVTSGFGGMANVAISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLSPLTLLPKEGLAMMNGTSVMTGIAANCVYDTQILTAIAMGVHALDIQALNGTNQSFHPFIHNSKPHPGQLWAADQMISLLANSQLVRDELDGKHDYRDHELIQDRYSLRCLPQYLGPIVDGISQIAKQIEIEINSVTDNPLIDVDNQASYHGGNFLGQYVGMGMDHLRYYIGLLAKHLDVQIALLASPEFSNGLPPSLLGNRERKVNMGLKGLQICGNSIMPLLTFYGNSIADRFPTHAEQFNQNINSQGYTSATLARRSVDIFQNYVAIALMFGVQAVDLRTYKKTGHYDARACLSPATERLYSAVRHVVGQKPTSDRPYIWNDNEQGLDEHIARISADIAAGGVIVQAVQDILPCLH

SEQ ID NO: 7 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgtcgccgctgaccctgcagccgaaagaaggtctggcaatgatgaatggcactagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatcatgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgactccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgtgcctgcat

SEQ ID NO: 8 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLSPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDHELIQDRYSLRCLPQYLGPIVDGISQIAKQIEIEINSVTDNPLIDVDNQASYHGGNFHGQYVGMGMDHLRYYIGLLAKHLDVQIALLASPEFSNGLTPSLVGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPCLH

SEQ ID NO: 9 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgtacgtgttgcccgtaatggcaccgctgttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatcatgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctgctgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgatatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtcaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 10 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDHELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLLGNRERKVNMGLKGLQICGNSIMPLLTFYGNSIADRFPTHAEQFNQNINSQGYTSATLARRSVDIFQNYVAIALMFGVQAVDLRTYKKTGHYDARAQLSPATERLYSAVRHVVGQKPSSDRPYIWNDNEQGLDEHIARISADIAAGGVIVQAVQDILPPLH

SEQ ID NO: 11 - DNA, 1701 bp, Artificial Sequence
  Variant of Phenylalanine Ammonia Lyase from Anabaena variabilis
atgaaaaccctgagtcaggctcagagcaaaaccagcagccagcagtttagctttaccggcaatagcagcgcaaatgtgattattggtaatcagaaactgaccatcaatgatgttgtacgtgttgcccgtaatggcacccttgttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgcttagcctgctggccggtagccagctggttcgtgatgaactggatggtaaacatgattatagggatcatgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtcaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 12 - protein, 567 aa, Artificial Sequence
  Variant of Phenylalanine Ammonia Lyase from Anabaena variabilis
MKTLSQAQSKTSSQQFSFTGNSSANVIIGNQKLTINDVVRVARNGTLVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDHELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGQKPSSDRPYIWNDNEQGLDEHIARISADIAAGGVIVQAVQDILPPLH

SEQ ID NO: 13 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgtacgtgttgcccgtaatggcaccgctgttagcctgaccaataataaagatattctgcagcgtattcaggccagctgtgattatatcaataatgcagttgaaaaaggtgaaccgatttatggtgttaccagcggttttggtggtatggcaaatgttgtgattagccgtgaacaggcaggcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcttggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtcaaaaaccgacctcagatcgtccgtatatttggaatgataatgaacagggtctggatgaacatattgcacgtattagtgcagatattgcagccggtggtgttattgttcaggccgttcaggacattctgccgtgcctgcat

SEQ ID NO: 14 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQAGELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFLGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGQKPTSDRPYIWNDNEQGLDEHIARISADIAAGGVIVQAVQDILPCLH

SEQ ID NO: 15 - DNA, 1701 bp, Artificial Sequence
  Variant of Phenylalanine Ammonia Lyase from Anabaena variabilis
atgaaaaccctgagtcaggctcagagcaaaaccagcagccagcagtttagctttaccggcaatagcagcgcaaatgtgattattggtaatcagaaactgaccatcaatgatgttgtgcgtgttgcccgtaatggcaccgcggttagcctgaccaataatacagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 16 - protein, 567 aa, Artificial Sequence
  Variant of Phenylalanine Ammonia Lyase from Anabaena variabilis
MKTLSQAQSKTSSQQFSFTGNSSANVIIGNQKLTINDVVRVARNGTAVSLTNNTDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 17 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgtgcgtgttgcccgtaatggcacccttgttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatcatgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctgctgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgtgcctgcat

SEQ ID NO: 18 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTLVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDHELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLLGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPCLH

SEQ ID NO: 19 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgtacgtgttgcccgtaatggcaccgctgttagcctgaccaataataaagatattctgcagcgtattcaggccagctgtgattatatcaataatgcagttgaaaagggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 20 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLLPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 21 - DNA, 1701 bp, Artificial Sequence
  Variant of Phenylalanine Ammonia Lyase from Anabaena variabilis
atgaaaaccctgagtcaggctcagagcaaaaccagcagccagcagtttagccacaccggcaatagcagcgcaaatgtgattattggtaatcagaaactgaccatcaatgatgttgtacgtgttgcccgtaatggcaccgctgttagcctgaccaataataaagatattctgcagcgtattcaggccagctgtgattatatcaataatgcagttgaaagtggtgaaccgatttatggtgttaccagcggttttggtggtatggcaaatgttgtgattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 22 - protein, 567 aa, Artificial Sequence
  Variant of Phenylalanine Ammonia Lyase from Anabaena variabilis
MKTLSQAQSKTSSQQFSHTGNSSANVIIGNQKLTINDVVRVARNGTAVSLTNNKDILQRIQASCDYINNAVESGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 23 - DNA, 1701 bp, Artificial Sequence
  Variant of Phenylalanine Ammonia Lyase from Anabaena variabilis
atgaaaaccctgagtcaggctcagagcaaaaccagcagccagcagtttagctttaccggcaatagcagcgcaaatgtgattattggtaatcagaaactgaccatcaatgatgttgtacgtgttgcccgtaatggcacccttgttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgtcgccgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcttggtcagtatgttggtatgggtatggatcatctgcgctattatatcggtctgctggcaaaacatctggatgttcagattgcactgctggcatcaccggaatttagcaatggtctgcctccgagtctgctgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtcaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 24 - protein, 567 aa, Artificial Sequence
  Variant of Phenylalanine Ammonia Lyase from Anabaena variabilis
MKTLSQAQSKTSSQQFSFTGNSSANVIIGNQKLTINDVVRVARNGTLVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLSPLTLLPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFLGQYVGMGMDHLRYYIGLLAKHLDVQIALLASPEFSNGLPPSLLGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGQKPSSDRPYIWNDNEQGLDEHIARISADIAAGGVIVQAVQDILPPLH

SEQ ID NO: 25 - DNA, 1701 bp, Artificial Sequence
  Variant of Phenylalanine Ammonia Lyase from Anabaena variabilis
atgaaaaccctgagtcaggctcagagcaaaaccagcagccagcagtttagccacaccggcaatagcagcgcaaatgtgattattggtaatcagaaactgaccatcaatgatgttgtacgtgttgcccgtaatggcaccgcggttagcctgaccaataataaagatattctgcagggtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatcatgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgtgcctgcat

SEQ ID NO: 26 - protein, 567 aa, Artificial Sequence
  Variant of Phenylalanine Ammonia Lyase from Anabaena variabilis
MKTLSQAQSKTSSQQFSHTGNSSANVIIGNQKLTINDVVRVARNGTAVSLTNNKDILQGIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDHELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPCLH

SEQ ID NO: 27 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 28 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 29 - DNA, 1701 bp, Artificial Sequence
  Variant of Phenylalanine Ammonia Lyase from Anabaena variabilis
atgaaaaccctgagtcaggctcagagcaaaaccagcagccagcagtttagccacaccggcaatagcagcgcaaatgtgattattggtaatcagaaactgaccatcaatgatgttgtacgtgttgcccgtaatggcaccgcggttagcctgaccaataataaagatattctgcagggtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgtgcctgcat

SEQ ID NO: 30 - protein, 567 aa, Artificial Sequence
  Variant of Phenylalanine Ammonia Lyase from Anabaena variabilis
MKTLSQAQSKTSSQQFSHTGNSSANVIIGNQKLTINDVVRVARNGTAVSLTNNKDILQGIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLLPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPCLH

SEQ ID NO: 31 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgatatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 32 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVDIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 33 - DNA, 1701 bp, Artificial Sequence
  Variant of Phenylalanine Ammonia Lyase from Anabaena variabilis
atgaaaaccctgagtcaggctcagagcaaaaccagcagccagcagtttagccacaccggcaatagcagcgcaaatgtgattattggtaatcagaaactgaccatcaatgatgttgcgcgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgtcgccgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctgctgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 34 - protein, 567 aa, Artificial Sequence
  Variant of Phenylalanine Ammonia Lyase from Anabaena variabilis
MKTLSQAQSKTSSQQFSHTGNSSANVIIGNQKLTINDVARVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLSPLTLLPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLLGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 35 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtgcgtgttgcccgtaatggcaccgctgttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 36 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLLPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 37 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaacagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaagggtgaaccgatttatggtgttaccagcggttttggtggtatggcaaatgttgtgattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 38 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 39 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcctgcctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 40 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVEIFQNYVAIALMFGVQAVDLRTYKKTGHYDARACLSPATERLYSAVRHVVGKKPSSDRPYIWNDNEQGLDEHIARISADIAAGGVIVQAVQDILPPLH

SEQ ID NO: 41 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtgcgtgttgcccgtaatggcaccgctgttagcctgaccaataataaagatattctgcagcgtattcaggccagctgtgattatatcaataatgcagttgaaaaaggtgaaccgatttatggtgttaccagcggttttggtggtatggcaaatgttgtgattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgattagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 42 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMISLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 43 - DNA, 1701 bp, Artificial Sequence
  Variant of Phenylalanine Ammonia Lyase from Anabaena variabilis
atgaaaaccctgagtcaggctcagagcaaaaccagcagccagcagtttagctttaccggcaatagcagcgcaaatgtgattattggtaatcagaaactgaccatcaatgatgttgtgcgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgtcgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 44 - protein, 567 aa, Artificial Sequence
  Variant of Phenylalanine Ammonia Lyase from Anabaena variabilis
MKTLSQAQSKTSSQQFSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPSLTLLPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 45 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgtacgtgttgcccgtaatggcaccgctgttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgacctcagatcgtccgtatatttggaatgataatgaacagggtctggatgaacatattgcacgtattagtgcagatattgcagccggtggtgttattgttcaggccgttcaggacattctgccgtgcctgcat

SEQ ID NO: 46 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPTSDRPYIWNDNEQGLDEHIARISADIAAGGVIVQAVQDILPCLH

SEQ ID NO: 47 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 48 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 49 - DNA, 1701 bp, Artificial Sequence
  Variant of Phenylalanine Ammonia Lyase from Anabaena variabilis
atgaaaaccctgagtcaggctcagagcaaaaccagcagccagcagtttagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtgattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgtcgccgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatattggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcctgcctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 50 - protein, 567 aa, Artificial Sequence
  Variant of Phenylalanine Ammonia Lyase from Anabaena variabilis
MKTLSQAQSKTSSQQFSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLSPLTLLPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARACLSPATERLYSAVRHVVGKKPSSDRPYIWNDNEQGLDEHIARISADIAAGGVIVQAVQDILPPLH

SEQ ID NO: 51 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcacccttgttagcctgaccaataataaagatattctgcagggtattcaggccagctgtgattatatcaataatgcagttgaaaagggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgtcgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgtgcctgcat

SEQ ID NO: 52 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTLVSLTNNKDILQGIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPSLTLLPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPCLH

SEQ ID NO: 53 - DNA, 1701 bp, Artificial Sequence
  Variant of Phenylalanine Ammonia Lyase from Anabaena variabilis
atgaaaaccctgagtcaggctcagagcaaaaccagcagccagcagtttagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgatatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgtgcctgcat

SEQ ID NO: 54 - protein, 567 aa, Artificial Sequence
  Variant of Phenylalanine Ammonia Lyase from Anabaena variabilis
MKTLSQAQSKTSSQQFSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVDIFQNYVAIALMFGVQAVDLRTYKKTGHYDARAQLSPATERLYSAVRHVVGKKPSSDRPYIWNDNEQGLDEHIARISADIAAGGVIVQAVQDILPCLH

SEQ ID NO: 55 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgtgcgtgttgcccgtaatggcaccgctgttagcctgaccaataataaagatattctgcagcgtattcaggccagctgtgattatatcaataatgcagttgaaaagggtgaaccgatttatggtgttaccagcggttttggtggtatggcaaatgttgcgattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctgctgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 56 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVAISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLLGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 57 - DNA, 1701 bp, Artificial Sequence
  Variant of Phenylalanine Ammonia Lyase from Anabaena variabilis
atgaaaaccctgagtcaggctcagagcaaaaccagcagccagcagtttagccacaccggcaatagcagcgcaaatgtgattattggtaatcagaaactgaccatcaatgatgttgtacgtgttgcccgtaatggcaccgcggttagcctgaccaataataaagatattctgcagggtattcaggccagctgtgattatatcaataatgcagttgaaaaaggtgaaccgatttatggtgttaccagcggttttggtggtatggcaaatgttgtgattagccgtgaacaggcaggcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgtgcctgcat

SEQ ID NO: 58 - protein, 567 aa, Artificial Sequence
  Variant of Phenylalanine Ammonia Lyase from Anabaena variabilis
MKTLSQAQSKTSSQQFSHTGNSSANVIIGNQKLTINDVVRVARNGTAVSLTNNKDILQGIQASCDYINNAVEKGEPIYGVTSGFGGMANVVISREQAGELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPCLH

SEQ ID NO: 59 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtgattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggtgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgatatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgacctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 60 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVDIFQNYVAIALMFGVQAVDLRTYKKTGHYDARAQLSPATERLYSAVRHVVGKKPTSDRPYIWNDNEQGLDEHIARISADIAAGGVIVQAVQDILPPLH

SEQ ID NO: 61 - DNA, 1701 bp, Artificial Sequence
  Variant of Phenylalanine Ammonia Lyase from Anabaena variabilis
atgaaaaccctgagtcaggctcagagcaaaaccagcagccagcagtttagctttaccggcaatagcagcgcaaatgtgattattggtaatcagaaactgaccatcaatgatgttgtacgtgttgcccgtaatggcaccgcggttagcctgaccaataataaagatattctgcagggtattcaggccagctgtgattatatcaataatgcagttgaaaagggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatcatgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 62 - protein, 567 aa, Artificial Sequence
  Variant of Phenylalanine Ammonia Lyase from Anabaena variabilis
MKTLSQAQSKTSSQQFSFTGNSSANVIIGNQKLTINDVVRVARNGTAVSLTNNKDILQGIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDHELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 63 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatcagaaactgaccatcaatgatgttgcgcgtgttgcccgtaatggcacccttgttagcctgaccaataataaagatattctgcagcgtattcaggccagctgtgattatatcaataatgcagttgaaaagggtgaaccgatttatggtgttaccagcggttttggtggtatggcaaatgttgtgattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacaggcaaaccagaatattaacagccagggttataccagcgcaaccctggcacgtcgtagcgttgatatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 64 - protein, 567 aa, Artificial Sequence
  Variant of Phenylalanine Ammonia Lyase from Anabaena variabilis
MKTLSQAQSKTSSQQSSFTGNSSANVIIGNQKLTINDVARVARNGTLVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQANQNINSQGYTSATLARRSVDIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 65 - DNA, 1701 bp, Artificial Sequence
  Variant of Phenylalanine Ammonia Lyase from Anabaena variabilis
atgaaaaccctgagtcaggctcagagcaaaaccagcagccagcagtttagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgatatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 66 - protein, 567 aa, Artificial Sequence
  Variant of Phenylalanine Ammonia Lyase from Anabaena variabilis
MKTLSQAQSKTSSQQFSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVDIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 67 - DNA, 1701 bp, Artificial Sequence
  Variant of Phenylalanine Ammonia Lyase from Anabaena variabilis
atgaaaaccctgagtcaggctcagagcaaaaccagcagccagcagtttagccacaccggcaatagcagcgcaaatgtgattattggtaatcagaaactgaccatcaatgatgttgtacgtgttgcccgtaatggcacccttgttagcctgaccaataataaagatattctgcagcgtattcaggccagctgtgattatatcaataatgcagttgaaaagggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 68 - protein, 567 aa, Artificial Sequence
  Variant of Phenylalanine Ammonia Lyase from Anabaena variabilis
MKTLSQAQSKTSSQQFSHTGNSSANVIIGNQKLTINDVVRVARNGTLVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 69 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtgcgtgttgcccgtaatggcaccgctgttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatcatgaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcttggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgatatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgcccctgcat

SEQ ID NO: 70 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDHELIQDRYSLRCLPQYLGPIVDGISQIAKQIEIEINSVTDNPLIDVDNQASYHGGNFLGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVDIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 71 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtgattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgtcgccgctgaccctgctgccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatatggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 72 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLSPLTLLPKEGLAMMNGTSVMTGIAANCVYDTQILTAIAMGVHALDIQALNGTNQSFHPFIHNSKPHPGQLWAADQMLSLLAGSQLVRDELDGKHDYMDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 73 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgttattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgacgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 74 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMTNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 75 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgttattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgacgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttcaaattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagtgcattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 76 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMTNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQCINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 77 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgttattagccgtgaacaggccagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgacgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgcacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 78 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMTNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFMGQYVGMGMDHLRYYIGLLAKHLDVTIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 79 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttcagattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 80 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 81 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgttattagccgtgaacaggccagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttcaaattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgcacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 82 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 83 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgttattagccgtgaacaggccagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatgcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttcagattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgcacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 84 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYALRCLPQYLGPIVDGISQIAKQIEIEINSVTDNPLIDVDNQASYHGGNFHGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 85 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgttattagccgtgaacaggccagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatgcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagtgcattaacagccagggttataccagcgcaaccctggcacgtcgtagcgttgaaatttttcagaattatgttgccattgccctgatgtttggtgttcaggcagttgatctgcgcacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 86 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYALRCLPQYLGPIVDGISQIAKQIEIEINSVTDNPLIDVDNQASYHGGNFHGQYVGMGMDHLRYYIGLLAKHLDVTIALLASPEFSNGLPPSLVGNRERKVNMGLKGLQICGNSIMPLLTFYGNSIADRFPTHAEQFNQCINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 87 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttcagattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgcacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 88 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFMGQYVGMGMDHLRYYIGLLAKHLDVQIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 89 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgacgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttcaaattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgacgacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 90 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMTNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLTTYKKTGHYDARAQLSPATERLYSAVRHVVGKKPSSDRPYIWNDNEQGLDEHIARISADIAAGGVIVQAVQDILPPLH

SEQ ID NO: 91 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 92 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 93 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgttattagccgtgaacaggccagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgacgacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 94 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLTTYKKTGHYDARAQLSPATERLYSAVRHVVGKKPSSDRPYIWNDNEQGLDEHIARISADIAAGGVIVQAVQDILPPLH

SEQ ID NO: 95 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatgtatggtgttaccagcggttttggtggtatggcaaatgttgttattagccgtgaacaggccagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgacgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgcacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 96 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPMYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMTNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 97 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatagcctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgacgacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 98 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLTTYKKTGHYDARAQLSPATERLYSAVRHVVGKKPSSDRPYIWNDNEQGLDEHIARISADIAAGGVIVQAVQDILPPLH

SEQ ID NO: 99 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgttattagccgtgaacaggccagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttcaaattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagtgcattaacagccagggttataccagcgcaaccctggcacgtcgtagcgttgaaatttttcagaattatgttgccattgccctgatgtttggtgttcaggcagttgatctgcgcacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 100 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFMGQYVGMGMDHLRYYIGLLAKHLDVQIALLASPEFSNGLPPSLVGNRERKVNMGLKGLQICGNSIMPLLTFYGNSIADRFPTHAEQFNQCINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 101 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgttattagccgtgaacaggccagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttcagattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagtgcattaacagccagggttataccagcgcaaccctggcacgtcgtagcgttgaaatttttcagaattatgttgccattgccctgatgtttggtgttcaggcagttgatctgcgcacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 102 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVQIALLASPEFSMGLPPSLVGNRERKVNMGLKGLQICGNSIMPLLTFYGNSIADRFPTHAEQFNQCINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 103 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttatgcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttcaaattgcactgctggcatcaccggaatttagcaatggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 104 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYALRCLPQYLGPIVDGISQIAKQIEIEINSVTDNPLIDVDNQASYHGGNFMGQYVGMGMDHLRYYIGLLAKHLDVQIALLASPEFSNGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 105 - DNA, 1701 bp, Artificial Sequence
  Variant of Phenylalanine Ammonia Lyase from Anabaena variabilis
atgaaaaccctgagtcaggctcagagcaaaaccagcagccagcagtctagccacaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgacgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttcagattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgcacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 106 - protein, 567 aa, Artificial Sequence
  Variant of Phenylalanine Ammonia Lyase from Anabaena variabilis
MKTLSQAQSKTSSQQSSHTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMTNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFMGQYVGMGMDHLRYYIGLLAKHLDVQIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 107 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagattacgggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 108 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQITGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 109 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 110 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIALGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 111 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 112 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIQRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIALGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 113 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgcagggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgcgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 114 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALQGTNQSFHPFIHNSKPHPGQLWAADQMLSLLAGSQLVRDELDGKHDYRDGELIQDRYSLRCLPQYLGPIVDGISQIAKQIEIEINSATDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 115 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtgctaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 116 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICANSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 117 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgcgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 118 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSATDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 119 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 120 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIALGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 121 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagccacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 122 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSHITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 123 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 124 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 125 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 126 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 127 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagattacgggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 128 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQITGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 129 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgcagggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 130 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALQGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 131 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgcgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagattacgggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 132 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSATDNPLIDVDNQASYHGGNFHGQYVGMGMDHLRYYIGLLAKHLDVTIALLASPEFSMGLPPSLVGNRERKVNMGLKGLQITGNSIMPLLTFLGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 133 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 134 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFLGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 135 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgcgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 136 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSATDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 137 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagccacattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgcagggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 138 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSHITGSLIGLDPSFKVDFNGKEMDAPTALRQLNLPPLTLQPKEGLAMMNGTSVMTGIAANCVYDTQILTAIALGVHALDIQALQGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 139 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagccacattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 140 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSHITGSLIGLDPSFKVDFNGKEMDAPTALRQLNLPPLTLQPKEGLAMMNGTSVMTGIAANCVYDTQILTAIALGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 141 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagccacattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 142 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSHITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 143 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 144 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 145 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 146 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 147 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgcagggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 148 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIALGVHALDIQALQGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 149 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagccacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 150 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSHITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 151 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgcagggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 152 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIALGVHALDIQALQGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 153 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatcagtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtgctaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 154 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHQFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICANSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 155 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgcgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 156 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIALGVHALDIQALNGTNQSFHPFIHNSKPHTGQLWAADQMLSLLAGSQLVRDELDGKHDYRDGELIQDRYSLRCLPQYLGPIVDGISQIAKQIEIEINSATDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 157 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagattacgggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 158 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIQRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQITGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 159 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgcgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 160 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSATDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 161 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgcagggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 162 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALQGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 163 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagattacgggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 164 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIQRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQITGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 165 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 166 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 167 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgcgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 168 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSATDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 169 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 170 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIALGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 171 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagattacgggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 172 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIALGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQITGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 173 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 174 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 175 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagccacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgcagggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 176 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSHITGSLIGLDPSFKVDFNGKEMDAPTALRQLNLPPLTLQPKEGLAMMNGTSVMTGIAANCVYDTQILTAIAMGVHALDIQALQGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 177 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgcagggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 178 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIQRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALQGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 179 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgcagggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagattacggctaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 180 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALQGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQITANSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 181 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 182 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIQRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 183 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgcagggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 184 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIALGVHALDIQALQGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 185 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgcgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 186 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIALGVHALDIQALNGTNQSFHPFIHNSKPHTGQLWAADQMLSLLAGSQLVRDELDGKHDYRDGELIQDRYSLRCLPQYLGPIVDGISQIAKQIEIEINSATDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 187 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 188 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFLGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 189 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagccacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 190 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSHITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 191 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagactgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtgctaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 192 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVRLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICANSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 193 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 194 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 195 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 196 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIQRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 197 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagccacattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 198 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSHITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 199 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgcgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagattacgggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 200 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIQRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSATDNPLIDVDNQASYHGGNFHGQYVGMGMDHLRYYIGLLAKHLDVTIALLASPEFSMGLPPSLVGNRERKVNMGLKGLQITGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 201 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgcagggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 202 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALQGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 203 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagccacattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 204 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSHITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 205 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 206 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 207 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgcagggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 208 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIALGVHALDIQALQGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 209 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcactgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatatcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 210 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIALGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHIVGKKPSSDRPYIWNDNEQGLDEHIARISADIAAGGVIVQAVQDILPPLH

SEQ ID NO: 211 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 212 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 213 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgcgtcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 214 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIQRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 215 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgcagggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgtggtaatagcattatgccgctgctgaccttttacggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 216 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIQRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALQGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 217 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 218 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 219 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaagaaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctacattaccggtagtctgattggcctggacccgagctttaaagttgattttaatggcaaagaaatggacgcaccgaccgcactggagcagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgcagggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtgaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagattacgggtaatagcattatgccgctgctgacctttctgggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgtcgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 220 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALEQLNLPPLTLQPKEGLAMMNGTSVMTGIAANCVYDTQILTAIAMGVHALDIQALQGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQITGNSIMPLLTFLGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 221 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatacgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 222 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHTGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 223 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcttccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 224 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLLPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 225 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtacggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 226 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERTVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 227 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcagcgccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 228 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLAAPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 229 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggcgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatgcggaactgatccaggatcgttattcgctgcgttgtctgccgcagtatctgggtccgattgttgatggtattagccagattgccaaacaaatcgaaattgagattaacagcgttacagataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 230 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDAELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 231 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatatggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 232 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNMVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 233 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctatcatatcggtctgctggcaaaacatctggatgttaccattgcactgctggcatcaccggaatttagcatgggtctgcctccgagtctgctgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 234 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYHIGLLAKHLDVTIALLASPEFSMGLPPSLLGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 235 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaatggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 236 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVENGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 237 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgtttgtgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 238 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVCDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 239 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatgttgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtaatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 240 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNVERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRNVVGKKPSSDRPYIWNDNEQGLDEHIARISADIAAGGVIVQAVQDILPPLH

SEQ ID NO: 241 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaggttaatatgggtctgaaaggtctgcagatttgcggtaatagcattatgccgctgctgacattttatggtaatagtattgcagatcgttttccgacccatgccgaacagttcaaccagaatattaacagccagggttataccagcgcaaccatggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 242 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATMARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 243 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagtataaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 244 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQYNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 245 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattttgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 246 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNFERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 247 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggttcatcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 248 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVHHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 249 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtccggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 250 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERPVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 251 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattataggcctggggaactgatccaggatcgttattcgctgcgttgtctgccgcagtatctgggtccgattgttgatggtattagccagattgccaaacaaatcgaaattgagattaacagcgttaccgataacccgcttattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 252 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRPGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 253 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctgttgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 254 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLLGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 255 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctggggtatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 256 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLGYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 257 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctggctccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 258 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLAPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 259 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 260 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 261 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatgttgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 262 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNVERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 263 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgtgggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 264 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGVGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 265 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcatccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccaccgctgcat

SEQ ID NO: 266 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLHPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 267 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagccttaccaataataaagatattctgcagcgtattccggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 268 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIPASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 269 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 270 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 271 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaaaggaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccactgcat

SEQ ID NO: 272 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQAKELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 273 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtacggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttaaggccgttcaggacattctgccgccgctgcat

SEQ ID NO: 274 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERTVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVKAVQDILPPLH

SEQ ID NO: 275 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaagctggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 276 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEAGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 277 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtaatggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 278 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGNGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 279 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaggtgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 280 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQAGELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 281 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgcgaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattataggggtgaggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccaagtctggtgggtaatcgtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 282 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVAKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRGEELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 283 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctgacctcaccggaatttagcatgggtctgcctccgagtctggtgggtaatcgtgaacgtcctgttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 284 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLTSPEFSMGLPPSLVGNRERPVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 285 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgagaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggtcccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattataggggtggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcctcaccggaatttagcatgggtctgcctccaagtctggtgggtaatcgtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 286 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRGGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 287 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgagaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctgtcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggtcccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcctcaccggaatttagcatgggtctgcctgcaagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 288 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLSDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPASLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 289 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaaaggaactgcagaccaatctggtgtggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggtcccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcctcaccggaatttagcatgggtctgcctgcaagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 290 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQAKELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPASLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 291 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgccagtaatggcaccgcggttagcctgaccaataataaagatattctgcagcgtattcaggccagctgtgattatatcaataatgcagttgagaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggtcccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccaagtctggtgggtaatagtgaacgtcctgttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 292 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVASNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERPVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 293 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgagaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattataggggtgaggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctgacctcaccggaatttagcatgggtctgcctgcaagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 294 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRGEELIQDRYSLRCLPQYLGPIVDGISQIAKQIEIEINSVTDNPLIDVDNQASYHGGNFHGQYVGMGMDHLRYYIGLLAKHLDVTIALLTSPEFSMGLPASLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 295 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggtcccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattataggggtgaggaaccgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcctcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 296 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRGEEPIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 297 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgcgaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggtcccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcctcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 298 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVAKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 299 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgagaaaggtgaaccgatttatggtgttaccagcggttttggtggtatggcaaatgttgtaattagccgtgaacaggcaagtgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggtcccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattataggggtgaggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctgacctcaccggaatttagcatgggtctgcctccaagtctggtgggtaatcgtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 300 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRGEELIQDRYSLRCLPQYLGPIVDGISQIAKQIEIEINSVTDNPLIDVDNQASYHGGNFHGQYVGMGMDHLRYYIGLLAKHLDVTIALLTSPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 301 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagtgaactgcagaccaatctggtgtggcacctgaaagtgggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggtcccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatcgtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 302 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKVGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 303 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgcgaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattataggggtggggaaccgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcctcaccggaatttagcatgggtctgcctccaagtctggtgggtaatcgtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 304 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVAKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRGGEPIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNRERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 305 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgagaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattataggggtggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcctcaccggaatttagcatgggtctgcctccaagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 306 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRGGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 307 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 308 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 309 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggtcccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctgacctcaccggaatttagcatgggtctgcctccaagtctggtgggtaatagtgaacgtaaagttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 310 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLTSPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 311 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagttatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctgacgtcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccatggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 312 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLTSPEFSMGLPPSLVGNSERKVNMGLKGLQICGNSIMPLLTFYGNSIADRFPTHAEQFNQNINSQGYTSATMARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 313 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaactggtgcaggtaacaaactgccgctggcggatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagttatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggacggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctgacgtcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccatggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 314 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLTSPEFSMGLPPSLVGNPERKVNMGLKGLQICGNSIMPLLTFYGNSIADRFPTHAEQFNQNINSQGYTSATMARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 315 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagttatattaccggtagtctgattggcctggacccgagctttaaagttgattttaatggcaaagaaatggacgcaccgaccgcactgagacagctgaatctgccgccgctgaccctggccccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggacggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcgtcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagtacaaccagaatattaacagccagggttataccagcgcaaccatggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 316 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLAPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQYNQNINSQGYTSATMARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 317 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattccggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaactggtgcaggtaacaaactgccgctggcggatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagttatattaccggtagcctgattggcctggacccgagctttaaagttgattttaatggcaaagaaatggacgcaccgaccgcactgagacagctgaatctgccgccgctgaccctggccccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggacggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcgtcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccatggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 318 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIPASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLAPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATMARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 319 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattccggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcgtcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 320 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIPASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 321 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctggccccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcgtcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 322 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLAPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 323 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaactggtgcaggtaaaaaactgccgctggcggatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatgttgaacgtcctgttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 324 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNVERPVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 325 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaactggtgcaggtaaaaaactgccgctgtcggatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcgtcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 326 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGKKLPLSDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 327 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggacggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcgtcaccggaatttagcatgggtctgcctccgagtctggtgggtaatgttgaacgtaaggttaatatgggtatgaaaggtctgcagatttgcggtaatagcattatgccgctgctgaccttttatggtaatagtattgcagatcgttttccgacccatgccgaacagtacaaccagaatattaacagccagggttataccagcgcaaccatggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 328 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNVERKVNMGMKGLQICGNSIMPLLTFYGNSIADRFPTHAEQYNQNINSQGYTSATMARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 329 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccatggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 330 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATMARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 331 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggacggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcgtcaccggaatttagcatgggtctgcctccgagtctggtgggtaatagtgaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 332 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 333 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagtcagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatgaagcagttcgtcatgttgttggtaaaaaaccgagctcagatcgtccgtatatttggaatgatgacgaacagggtctggatgaacatattgcacgtattagtgcagatattgcagccggtggtgttattgttcaggccgttcaggacattctgccgccgctgcat

SEQ ID NO: 334 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYEAVRHVVGKKPSSDRPYIWNDDEQGLDEHIARISADIAAGGVIVQAVQDILPPLH

SEQ ID NO: 335 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatgaagcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 336 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYEAVRHVVGKKPSSDRPYIWNDNEQGLDEHIARISADIAAGGVIVQAVQDILPPLH

SEQ ID NO: 337 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 338 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 339 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaagatgttcgtgcagcaatgctgctgcgtgcaaatagccacatgcgtggtgcaagcggtattcgtctggaactgattcagcgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 340 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIQRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 341 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagtcagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 342 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 343 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagtggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccggttgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgatgacgaacagggtctggatgaacatattgcacgtattagtgcagatattgcagccggtggtgttattgttcaggccgttcaggacattctgccgccgctgcat

SEQ ID NO: 344 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPVVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDDEQGLDEHIARISADIAAGGVIVQAVQDILPPLH

SEQ ID NO: 345 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatgaagcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 346 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYEAVRHVVGKKPSSDRPYIWNDNEQGLDEHIARISADIAAGGVIVQAVQDILPPLH

SEQ ID NO: 347 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtacgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccctgcgtctgtatgaagcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 348 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATLRLYEAVRHVVGKKPSSDRPYIWNDNEQGLDEHIARISADIAAGGVIVQAVQDILPPLH

SEQ ID NO: 349 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccctgcgtctgtatgaagcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 350 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATLRLYEAVRHVVGKKPSSDRPYIWNDNEQGLDEHIARISADIAAGGVIVQAVQDILPPLH

SEQ ID NO: 351 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattcagcgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccctgcgtctgtatgaagcagttcgtcatgttgttggtaaaaaaccgagctcagatcgtccgtatatttggaatgatgacgaacagggtctggatgaacatattgcacgtattagtgcagatattgcagccggtggtgttattgttcaggccgttcaggacattctgccgccgctgcat

SEQ ID NO: 352 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIQRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATLRLYEAVRHVVGKKPSSDRPYIWNDDEQGLDEHIARISADIAAGGVIVQAVQDILPPLH

SEQ ID NO: 353 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaagatgttcgtgcagcaatgctgctgcgtgcaaatagccacatgcgtggtgcaagcggtattcgtctggaactgattaagcgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccctgcgtctgtatgaagcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 354 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATLRLYEAVRHVVGKKPSSDRPYIWNDNEQGLDEHIARISADIAAGGVIVQAVQDILPPLH

SEQ ID NO: 355 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccctgcgtctgtatgaagcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 356 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATLRLYEAVRHVVGKKPSSDRPYIWNDNEQGLDEHIARISADIAAGGVIVQAVQDILPPLH

SEQ ID NO: 357 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcaggatctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaagatgttcgtgcagcaatgctgctgcgtgcaaatagccacatgcgtggtgcaagcggtattcgtctggaactgattaagcgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatatccaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagtcagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatgaagcagttcgtcatgttgttggtaaaaaaccgagctcagatcgtccgtatatttggaatgatgacgaacagggtctggatgaacatattgcacgtattagtgcagatattgcagccggtggtgttattgttcaggccgttcaggacattctgccgccgctgcat

SEQ ID NO: 358 - protein, 567 aa, Artificial Sequence
  Variant of Phenylalanine Ammonia Lyase from Anabaena variabilis
MKTLSQAQSKTSSQQSSFTGNSSANVIIGNQDLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYEAVRHVVGKKPSSDRPYIWNDDEQGLDEHIARISADIAAGGVIVQAVQDILPPLH

SEQ ID NO: 359 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccggttgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccctgcgtctgtatgaagcagttcgtcatgttgttggtaaaaaaccgagctcagatcgtccgtatatttggaatgatgacgaacagggtctggatgaacatattgcacgtattagtgcagatattgcagccggtggtgttattgttcaggccgttcaggacattctgccgccgctgcat

SEQ ID NO: 360 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPVVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATLRLYEAVRHVVGKKPSSDRPYIWNDDEQGLDEHIARISADIAAGGVIVQAVQDILPPLH

SEQ ID NO: 361 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcaggatctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatcgtgatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccctgcgtctgtatgaagcagttcgtcatgttgttggtaaaaaaccgagctcagatcgtccgtatatttggaatgatgacgaacagggtctggatgaacatattgcacgtattagtgcagatattgcagccggtggtgttattgttcaggccgttcaggacattctgccgccgctgcat

SEQ ID NO: 362 - protein, 567 aa, Artificial Sequence
  Variant of Phenylalanine Ammonia Lyase from Anabaena variabilis
MKTLSQAQSKTSSQQSSFTGNSSANVIIGNQDLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATLRLYEAVRHVVGKKPSSDRPYIWNDDEQGLDEHIARISADIAAGGVIVQAVQDILPPLH

SEQ ID NO: 363 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtacgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccctgcgtctgtatgaagcagttcgtcatgttgttggtaaaaaaccgagctcagatcgtccgtatatttggaatgatgacgaacagggtctggatgaacatattgcacgtattagtgcagatattgcagccggtggtgttattgttcaggccgttcaggacattctgccgccgctgcat

SEQ ID NO: 364 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATLRLYEAVRHVVGKKPSSDRPYIWNDDEQGLDEHIARISADIAAGGVIVQAVQDILPPLH

SEQ ID NO: 365 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaagcgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatgaagcagttcgtcatgttgttggtaaaaaaccgagctcagatcgtccgtatatttggaatgatgacgaacagggtctggatgaacatattgcacgtattagtgcagatattgcagccggtggtgttattgttcaggccgttcaggacattctgccgccgctgcat

SEQ ID NO: 366 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYEAVRHVVGKKPSSDRPYIWNDDEQGLDEHIARISADIAAGGVIVQAVQDILPPLH

SEQ ID NO: 367 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 368 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGGKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 369 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaagcgccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 370 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKAPSSDRPYIWNDNEQGLDEHIARISADIAAGGVIVQAVQDILPPLH

SEQ ID NO: 371 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttatggatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 372 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVMDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 373 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcacagggtggtgttattgttcaggccgttcaggacattctgccgccgctgcat

SEQ ID NO: 374 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGVIVQAVQDILPPLH

SEQ ID NO: 375 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaggtctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 376 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLGLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 377 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcggcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataataaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 378 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNKASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 379 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtggttatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 380 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGGYDARAQLSPATERLYSAVRHVVGKKPSSDRPYIWNDNEQGLDEHIARISADIAAGGVIVQAVQDILPPLH

SEQ ID NO: 381 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtcatgatattgcagccggtggtgttattgttcaggccgttcaggacattctgccgccgctgcat

SEQ ID NO: 382 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISHDIAAGGVIVQAVQDILPPLH

SEQ ID NO: 383 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 384 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 385 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagcggggatcgtccgtatatttggaatgataatgaacagggtctggatgaacatattgcacgtattagtgcagatattgcagccggtggtgttattgttcaggccgttcaggacattctgccgccgctgcat

SEQ ID NO: 386 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSGDRPYIWNDNEQGLDEHIARISADIAAGGVIVQAVQDILPPLH

SEQ ID NO: 387 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttctgaatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 388 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVLNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 389 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgggtattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 390 - protein, 567 aa, Artificial Sequence
  Variant of Phenylalanine Ammonia Lyase from Anabaena variabilis
MKTLSQAQSKTSSQQSSFTGNSSANVGIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 391 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattggtcagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 392 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGIGQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 393 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagagggtggtgttattgttcaggccgttcaggacattctgccgccgctgcat

SEQ ID NO: 394 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAEGGVIVQAVQDILPPLH

SEQ ID NO: 395 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcaggtcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 396 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAAGQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 397 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgttcgcagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 398 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARSQLSPATERLYSAVRHVVGKKPSSDRPYIWNDNEQGLDEHIARISADIAAGGVIVQAVQDILPPLH

SEQ ID NO: 399 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgagcagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 400 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 401 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgatattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccatatatttggaatgataatgaacagggtctggatgaacatattgcacgtattagtgcagatattgcagccggtggtgttattgttcaggccgttcaggacattctgccgccgctgcat

SEQ ID NO: 402 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIDIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 403 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattcctcagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 404 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGIPQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 405 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcgggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 406 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNRASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 407 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattcatcagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 408 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGIHQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 409 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgctcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaacttgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 410 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGAHALDIQALNGTNQSFHPFIHNSKPHPGQLWAADQMLSLLAGSQLVRDELDGKHDYRDGELIQDRYSLRCLPQYLGPIVDGISQIAKQIELEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 411 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggagggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcaggttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 412 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLEGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRQVVGKKPSSDRPYIWNDNEQGLDEHIARISADIAAGGVIVQAVQDILPPLH

SEQ ID NO: 413 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcgggacattctgccgccgctgcat

SEQ ID NO: 414 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVRDILPPLH

SEQ ID NO: 415 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctggtgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 416 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLVPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 417 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatcctctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 418 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDPLQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 419 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttctgggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 420 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFLGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 421 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtggggttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 422 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRGVVGKKPSSDRPYIWNDNEQGLDEHIARISADIAAGGVIVQAVQDILPPLH

SEQ ID NO: 423 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttactgttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 424 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFTVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 425 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcgtgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 426 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVRDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 427 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctggggccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 428 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLGPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 429 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgggcagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 430 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDNEQGLDEHIARISADIAAGGVIVQAVQDILPPLH

SEQ ID NO: 431 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatacttttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 432 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHTFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 433 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtatttcggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 434 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRISASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 435 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcgcggatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 436 - protein, 567 aa, Artificial Sequence
  Variant of Phenylalanine Ammonia Lyase from Anabaena variabilis
MKTLSQAQSKTSSQQSSFTGNSSANVIIGNQKLTIADVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 437 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttagtgacattctgccgccgctgcat

SEQ ID NO: 438 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVSDILPPLH

SEQ ID NO: 439 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtatgtatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 440 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGMYDARAQLSPATERLYSAVRHVVGKKPSSDRPYIWNDNEQGLDEHIARISADIAAGGVIVQAVQDILPPLH

SEQ ID NO: 441 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaacggagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 442 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIETEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 443 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaatgtgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 444 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIECEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 445 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgacgtcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 446 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPTSDRPYIWNDNEQGLDEHIARISADIAAGGVIVQAVQDILPPLH

SEQ ID NO: 447 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaccgccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 448 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKPPSSDRPYIWNDNEQGLDEHIARISADIAAGGVIVQAVQDILPPLH

SEQ ID NO: 449 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatctttaatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 450 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYIFNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 451 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagagcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 452 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAAEQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 453 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtcagattgttcaggccgttcaggacattctgccgccgctgcat

SEQ ID NO: 454 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 455 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccatgagagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttgggatgataatgaacagggtctggatgaacatattgcacgtattagtgcagatattgcagccggtggtgttattgttcaggccgttcaggacattctgccgccgctgcat

SEQ ID NO: 456 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHESKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWDDNEQGLDEHIARISADIAAGGVIVQAVQDILPPLH

SEQ ID NO: 457 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttttgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 458 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVFDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 459 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaatgatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 460 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINDAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 461 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccggtgtcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 462 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPVSDRPYIWNDNEQGLDEHIARISADIAAGGVIVQAVQDILPPLH

SEQ ID NO: 463 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcgaggatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 464 - protein, 567 aa, Artificial Sequence
  Variant of Phenylalanine Ammonia Lyase from Anabaena variabilis
MKTLSQAQSKTSSQQSSFTGNSSANVIIGNQKLTIEDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 465 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctgcagggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 466 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLQGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 467 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataatactgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 468 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNTDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 469 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgatcagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 470 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARDQLSPATERLYSAVRHVVGKKPSSDRPYIWNDNEQGLDEHIARISADIAAGGVIVQAVQDILPPLH

SEQ ID NO: 471 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcatgtggtggtgttattgttcaggccgttcaggacattctgccgccgctgcat

SEQ ID NO: 472 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIACGGVIVQAVQDILPPLH

SEQ ID NO: 473 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgacggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 474 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPTADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 475 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgatgatattgcagccggtggtgttattgttcaggccgttcaggacattctgccgccgctgcat

SEQ ID NO: 476 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISDDIAAGGVIVQAVQDILPPLH

SEQ ID NO: 477 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcaacgggtggtgttattgttcaggccgttcaggacattctgccgccgctgcat

SEQ ID NO: 478 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIATGGVIVQAVQDILPPLH

SEQ ID NO: 479 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttgaggacattctgccgccgctgcat

SEQ ID NO: 480 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVEDILPPLH

SEQ ID NO: 481 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctggcgcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 482 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILARIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 483 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaagggccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 484 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKGPSSDRPYIWNDNEQGLDEHIARISADIAAGGVIVQAVQDILPPLH

SEQ ID NO: 485 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 486 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 487 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccatacgagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 488 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHTSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 489 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgatgtgcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 490 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDVQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 491 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtggtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 492 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARGSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 493 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccgggcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 494 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 495 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgggatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 496 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVGIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 497 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtggatattggtaatcagaaactgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtatgtttatgaatttggtagcattggtgccagcggtgatctggttccgctgagctatattaccggtagcctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgtttatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattagccagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagcgcagttcgtcatgttgttggtaaaaaaccgagctcagatcgtccgtatatttggaatgataatgaacagggtctggatgaacatattgcacgtattagtgcagatattgcagccggtggtgttattgttcaggccgttcaggacattctgccgccgctgcat

SEQ ID NO: 498 - protein, 567 aa, Artificial Sequence
  Variant of Phenylalanine Ammonia Lyase from Anabaena variabilis
MKTLSQAQSKTSSQQSSFTGNSSANVDIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVYDTQILTAIAMGVHALDIQALNGTNQSFHPFIHNSKPHPGQLWAADQMLSLLAGSQLVRDELDGKHDYRDGELIQDRYSLRCLPQYLGPIVDGISQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 499 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgctgatattgcagccggtggtgttattgttcaggccgttcaggacattctgccgccgctgcat

SEQ ID NO: 500 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 501 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataatccggatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttatggatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 502 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVMDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 503 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 504 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 505 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttatggatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtggtgttgttggtaaaaaaccgagctcagatcgtccgtatatttggaatgataacgaacagggtctggatgaacatattgcacgtattagtgctgatattgcagccggtggtgttattgttcaggccgttcaggacattctgccgccgctgcat

SEQ ID NO: 506 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVMDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRGVVGKKPSSDRPYIWNDNEQGLDEHIARISADIAAGGVIVQAVQDILPPLH

SEQ ID NO: 507 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcgcgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 508 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVRDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 509 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataatccggatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataataaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgctgatattgcagccggtggtgttattgttcaggccgttcaggacattctgccgccgctgcat

SEQ ID NO: 510 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNKASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDNEQGLDEHIARISADIAAGGVIVQAVQDILPPLH

SEQ ID NO: 511 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagagcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 512 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAAEQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDNEQGLDEHIARISADIAAGGVIVQAVQDILPPLH

SEQ ID NO: 513 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttatggatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 514 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVMDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDNEQGLDEHIARISADIAAGGVIVQAVQDILPPLH

SEQ ID NO: 515 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatccggatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttatggatacccagattctgaccgcaattgcaatgggtgttcatgcactggatctgcaggcactgaatggtacaaatcagagctttcatccgtttatccataacagcaaaccgcatccgggtcagctgtgggcagcagagcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 516 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVMDTQILTAIAMGVHALDLQALNGTNQSFHPFIHNSKPHPGQLWAAEQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 517 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcacgttgttggtaaaaaaccgagctcagatcgtccgtatatttggaatgataacgaacagggtctggatgaacatattgcacgtattagtgctgatattgcagccggtggtgttattgttcaggccgttcaggacattctgccgccgctgcat

SEQ ID NO: 518 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 519 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtggggattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagagcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgctgatattgcagccggtggtgttattgttcaggccgttcaggacattctgccgccgctgcat

SEQ ID NO: 520 - protein, 567 aa, Artificial Sequence
  Variant of Phenylalanine Ammonia Lyase from Anabaena variabilis
MKTLSQAQSKTSSQQSSFTGNSSANVGIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAAEQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 521 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgatgatgaacagggtctggatgaacatattgcacgtattagtgatgatattgcagccggtggtgttattgttcaggccgttcaggacattctgccgccgctgcat

SEQ ID NO: 522 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDDEQGLDEHIARISDDIAAGGVIVQAVQDILPPLH

SEQ ID NO: 523 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagagcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 524 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAAEQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 525 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagagcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtggtgttgttggtaaaaaaccgagctcagatcgtccgtatatttggaatgataacgaacagggtctggatgaacatattgcacgtattagtgatgatattgcagccggtggtgttattgttcaggccgttcaggacattctgccgccgctgcat

SEQ ID NO: 526 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAAEQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRGVVGKKPSSDRPYIWNDNEQGLDEHIARISDDIAAGGVIVQAVQDILPPLH

SEQ ID NO: 527 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcgcgatacccagattctgaccgcaattgcaatgggtgttcatgcactggatctgcaggcactgaatggtacaaatcagagctttcatccgtttatccataacagcaaaccgcatccgggtcagctgtgggcagcagagcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtcacgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 528 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVRDTQILTAIAMGVHALDLQALNGTNQSFHPFIHNSKPHPGQLWAAEQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDNEQGLDEHIARISADIAAGGVIVQAVQDILPPLH

SEQ ID NO: 529 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataatccggatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcgcgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 530 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVRDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 531 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 532 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDNEQGLDEHIARISADIAAGGVIVQAVQDILPPLH

SEQ ID NO: 533 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatccggatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagagcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgctgatattgcagccggtggtgttattgttcaggccgttcaggacattctgccgccgctgcat

SEQ ID NO: 534 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAAEQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDNEQGLDEHIARISADIAAGGVIVQAVQDILPPLH

SEQ ID NO: 535 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtggggattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtcatgttgttggtaaaaaaccgagctcagatcgtccgtatatttggaatgatgatgaacagggtctggatgaacatattgcacgtattagtgcagatattgcagccggtggtgttattgttcaggccgttcaggacattctgccgccgctgcat

SEQ ID NO: 536 - protein, 567 aa, Artificial Sequence
  Variant of Phenylalanine Ammonia Lyase from Anabaena variabilis
MKTLSQAQSKTSSQQSSFTGNSSANVGIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDDEQGLDEHIARISADIAAGGVIVQAVQDILPPLH

SEQ ID NO: 537 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatccggatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcacgttgttggtaaaaaaccgagctcagatcgtccgtatatttggaatgataacgaacagggtctggatgaacatattgcacgtattagtgctgatattgcagccggtggtgttattgttcaggccgttcaggacattctgccgccgctgcat

SEQ ID NO: 538 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 539 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgatgatattgcagccggtggtgttattgttcaggccgttcaggacattctgccgccgctgcat

SEQ ID NO: 540 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISDDIAAGGVIVQAVQDILPPLH

SEQ ID NO: 541 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtggggattggtaatgataagctgaccatcaatgatgttgtacgtgttgcccgtaatggcaccgcggttagcctgaccaataatccggatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgctgatattgcagccggtggtgttattgttcaggccgttcaggacattctgccgccgctgcat

SEQ ID NO: 542 - protein, 567 aa, Artificial Sequence
  Variant of Phenylalanine Ammonia Lyase from Anabaena variabilis
MKTLSQAQSKTSSQQSSFTGNSSANVGIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 543 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagagcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgctgatattgcagccggtggtgttattgttcaggccgttcaggacattctgccgccgctgcat

SEQ ID NO: 544 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAAEQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 545 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 546 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDNEQGLDEHIARISADIAAGGVIVQAVQDILPPLH

SEQ ID NO: 547 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttatggatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtggccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 548 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVMDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARGQLSPATERLYSAVRHVVGKKPSSDRPYIWNDNEQGLDEHIARISADIAAGGVIVQAVQDILPPLH

SEQ ID NO: 549 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 550 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 551 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcacaaggtggtcagattgttcaggccgttcaggacattctgccgccgctgcat

SEQ ID NO: 552 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGQIVQAVQDILPPLH

SEQ ID NO: 553 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtgtcattgttcaggccgttcaggacattctgccgccgctgcat

SEQ ID NO: 554 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGGKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 555 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 556 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 557 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcgccgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 558 - protein, 567 aa, Artificial Sequence
  Variant of Phenylalanine Ammonia Lyase from Anabaena variabilis
MKTLSQAQSKTSSQQSSFTGNSSANVIIGNQKLTIADVVRVARNGTAVSLTNNKDILQRIQASCDYINNAVEKGEPIYGVTSGFGGMANVVISREQASELQTNLVWHLKTGAGGKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 559 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 560 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGGKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 561 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcacaaggtggtcagattgttcaggccgttcaggacattctgccgccgctgcat

SEQ ID NO: 562 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGQIVQAVQDILPPLH

SEQ ID NO: 563 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattccagccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaactgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcacaaggtggtcagattgttcaggccgttcaggacattctgccgccgctgcat

SEQ ID NO: 564 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIPASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIETEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGQIVQAVQDILPPLH

SEQ ID NO: 565 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagtctgctggcgggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaactgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 566 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIETEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 567 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagtctgctggcgggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 568 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 569 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaggtctgctggcgggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaactgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcacaaggtggtgtcattgttcaggccgttcaggacattctgccgccgctgcat

SEQ ID NO: 570 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLGLLAGSQLVRDELDGKHDYRDGELIQDRYSLRCLPQYLGPIVDGIEQIAKQIETEINSVTDNPLIDVDNQASYHGGNFMGQYVGMGMDHLRYYIGLLAKHLDVTIALLASPEFSMGLPPSLVGNSERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGVIVQAVQDILPPLH

SEQ ID NO: 571 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaggtctgctggcgggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaactgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtgtcattgttcaggccgttcaggacattctgccgccgctgcat

SEQ ID NO: 572 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGGKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLGLLAGSQLVRDELDGKHDYRDGELIQDRYSLRCLPQYLGPIVDGIEQIAKQIETEINSVTDNPLIDVDNQASYHGGNFHGQYVGMGMDHLRYYIGLLAKHLDVTIALLASPEFSMGLPPSLVGNSERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 573 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaggtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 574 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLGLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 575 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcacaaggtggtgtcattgttcaggccgttcaggacattctgccgccgctgcat

SEQ ID NO: 576 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGGKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGVIVQAVQDILPPLH

SEQ ID NO: 577 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 578 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 579 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagcaggtggtgtcattgttcaggccgttcaggacattctgccgccgctgcat

SEQ ID NO: 580 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 581 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaactgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcacaaggtggtgtcattgttcaggccgttcaggacattctgccgccgctgcat

SEQ ID NO: 582 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIETEINSVTDNPLIDVDNQASYHGGNFHGQYVGMGMDHLRYYIGLLAKHLDVTIALLASPEFSMGLPPSLVGNSERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGVIVQAVQDILPPLH

SEQ ID NO: 583 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaactgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 584 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLQGSQLVRDELDGKHDYRDGELIQDRYSLRCLPQYLGPIVDGIEQIAKQIETEINSVTDNPLIDVDNQASYHGGNFHGQYVGMGMDHLRYYIGLLAKHLDVTIALLASPEFSMGLPPSLVGNSERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 585 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 586 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGGKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFMGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 587 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaggtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 588 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLGLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 589 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaactgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcacaaggtggtgtcattgttcaggccgttcaggacattctgccgccgctgcat

SEQ ID NO: 590 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIETEINSVTDNPLIDVDNQASYHGGNFMGQYVGMGMDHLRYYIGLLAKHLDVTIALLASPEFSMGLPPSLVGNSERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGVIVQAVQDILPPLH

SEQ ID NO: 591 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagtctgctggcgggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaactgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtgtcattgttcaggccgttcaggacattctgccgccgctgcat

SEQ ID NO: 592 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGGKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIETEINSVTDNPLIDVDNQASYHGGNFMGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 593 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattccagccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaggtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcacaaggtggtcagattgttcaggccgttcaggacattctgccgccgctgcat

SEQ ID NO: 594 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIPASCDYINNAVEKGEPIYGVTSGFGGMANVVISREQASELQTNLVWHLKTGAGGKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLGLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGQIVQAVQDILPPLH

SEQ ID NO: 595 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtgggaaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtgtcattgttcaggccgttcaggacattctgccgccgctgcat

SEQ ID NO: 596 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGGKLPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 597 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcacaaggtggtgtcattgttcaggccgttcaggacattctgccgccgctgcat

SEQ ID NO: 598 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGVIVQAVQDILPPLH

SEQ ID NO: 599 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagtctgctggcgggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaagccgagctcagatcgtccgtatatttggaatgataacgaacagggtctggatgaacatattgcacgtattagtgcagatattgcagcaggtggtgtcattgttcaggccgttcaggacattctgccgccgctgcat

SEQ ID NO: 600 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 601 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaacgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaggtctgctgcagggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagcaggtggtcagattgttcaggccgttcaggacattctgccgccgctgcat

SEQ ID NO: 602 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLGLLQGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 603 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgcatgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 604 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPHVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 605 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccgtggccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 606 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAVALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 607 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcatttctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 608 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSAFLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 609 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagacgtatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 610 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQTYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 611 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccctggccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 612 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVALALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 613 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacactcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 614 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHTRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 615 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagttttatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 616 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQFYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 617 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtctggcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 618 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSLADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 619 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtatatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 620 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPYIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 621 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgcaggtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 622 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPQVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 623 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcaggctgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 624 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQAVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 625 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatttgtggaatgataacgaacagggtctggatgaacatattgcacgtattagtgcagatattgcagccggtggtgttattgttcaggccgttcaggacattctgccgccgctgcat

SEQ ID NO: 626 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYLWNDNEQGLDEHIARISADIAAGGVIVQAVQDILPPLH

SEQ ID NO: 627 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagcggtatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 628 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQRYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 629 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaacatggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 630 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEHGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 631 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacgcggttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 632 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINAVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 633 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgctttttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 634 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALLFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 635 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcatgtagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 636 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRACSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 637 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtgtgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 638 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQCVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 639 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgctggtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 640 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPLVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 641 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagagtgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 642 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQSVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 643 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgattgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 644 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPIVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 645 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaaatgattgcacgtattagtgcagatattgcagccggtggtgttattgttcaggccgttcaggacattctgccgccgctgcat

SEQ ID NO: 646 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEMIARISADIAAGGVIVQAVQDILPPLH

SEQ ID NO: 647 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgacgccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 648 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLTPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 649 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcacttctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 650 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSALLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 651 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatatggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 652 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEYGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 653 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatgtttggaatgataacgaacagggtctggatgaacatattgcacgtattagtgcagatattgcagccggtggtgttattgttcaggccgttcaggacattctgccgccgctgcat

SEQ ID NO: 654 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYVWNDNEQGLDEHIARISADIAAGGVIVQAVQDILPPLH

SEQ ID NO: 655 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcagagctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 656 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 657 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcaggggtatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 658 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQGYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 659 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtgcgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 660 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCAPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 661 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagtcgtatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 662 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQSYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 663 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccgtggcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 664 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTVALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 665 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaaatgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 666 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKMPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 667 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattggtctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 668 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIGLMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 669 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagtgttatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 670 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQCYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 671 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccggtgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 672 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPVTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 673 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtgagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 674 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGEYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 675 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattttgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtatttctgatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 676 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSISDRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 677 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtcagagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 678 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGQSGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 679 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcaggagtatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 680 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQEYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 681 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaatctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 682 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSANLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 683 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaggtctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 684 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSAGLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 685 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatgttgatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 686 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHVDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 687 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttgcgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 688 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFATHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 689 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccatttcgctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 690 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAISLMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 691 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagcattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 692 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQHYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 693 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgtttcgatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 694 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVSMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 695 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtcggtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 696 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPSVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 697 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtgggtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 698 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPWVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 699 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaagttccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 700 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKVPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 701 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttatccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 702 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRYPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 703 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagctctaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 704 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSSTLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 705 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaatgctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 706 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSAMLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 707 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccgcggccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 708 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAAALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 709 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcatgatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 710 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSMMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 711 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgtttcgattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 712 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVSIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 713 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcattcgctggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 714 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHSLDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 715 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggtggcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 716 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWVADQMLSLLAGSQLVRDELDGKHDYRDGELIQDRYSLRCLPQYLGPIVDGIEQIAKQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 717 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatcagaagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcatgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccaaacaaatcgaaattgagattaacagcgttaccgataacccgctgattgatgttgataatcagcatagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatagtgaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 718 - protein, 567 aa, Artificial Sequence
  Variant of Phenylalanine Ammonia Lyase from Anabaena variabilis
MKTLSQAQSKTSSQQSSFTGNSSANVIIGNQKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAKQIEIEINSVTDNPLIDVDNQHSYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 719 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatatggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcgacgctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 720 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEYGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFMGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 721 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagctcgacgctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgttattgttcaggccgttcaggacattctgccgccgctgcat

SEQ ID NO: 722 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSSTLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 723 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgactccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcgacgctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 724 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFMGQYVGMGMDHLRYYIGLLAKHLDVTIALLASPEFSMGLTPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 725 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaagtgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcgacgctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgttattgttcaggccgttcaggacattctgccgccgctgcat

SEQ ID NO: 726 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKVPLEDVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFMGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 727 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgttattgttcaggccgttcaggacattctgccgccgctgcat

SEQ ID NO: 728 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 729 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatatggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcgacgctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 730 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEYGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 731 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcaggagtatgttgccatcgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgttattgttcaggccgttcaggacattctgccgccgctgcat

SEQ ID NO: 732 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQEYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 733 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatgtctggaatgataacgaacagggtctggatgaacatattgcacgtattagtgcagatattgcagccggtggtgttattgttcaggccgttcaggacattctgccgccgctgcat

SEQ ID NO: 734 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYVWNDNEQGLDEHIARISADIAAGGVIVQAVQDILPPLH

SEQ ID NO: 735 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgttattgttcaggccgttcaggacattctgccgccgctgcat

SEQ ID NO: 736 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 737 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaggatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaagtgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatatggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcgacgctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgttattgttcaggccgttcaggacattctgccgccgctgcat

SEQ ID NO: 738 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKVPLADVRAAMLLRANSHMRGASGIRLELIKRMEIFLNAGVTPYVYEYGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFMGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 739 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaggatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggaggatgttcgtgcagcaatgctgctgcgtgcaaatagccacatgcgtggtgcaagcggtattcgtctggaactgattaaacgcatggaaatctttctgaatgccggtgttaccccgtacgtttatgaatatggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcgacgctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 740 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLEDVRAAMLLRANSHMRGASGIRLELIKRMEIFLNAGVTPYVYEYGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 741 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagctcgacgctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 742 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSSTLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 743 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaattcggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 744 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNSERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 745 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataataaagatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcacggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcaaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatttggaatgataacgaacagggtctggatgaacatattgcacgtattagtgcagatattgcagccggtggtgttattgttcaggccgttcaggacattctgccgccgctgcat

SEQ ID NO: 746 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNKDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 747 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctgcaaggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaactgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaacattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagcaggtggtcaaattgttcaggccgttcaggacattctgccgccgctgcat

SEQ ID NO: 748 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLQGSQLVRDELDGKHDYRDGELIQDRYSLRCLPQYLGPIVDGIEQIAGQIETEINSVTDNPLIDVDNQASYHGGNFMGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 749 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggctggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaactgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgatgatgaacagggtctggatgaacatattgcacgtattagtgcagatattgcagccggtggtgttattgttcaggccgttcaggacattctgccgccgctgcat

SEQ ID NO: 750 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIETEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDDEQGLDEHIARISADIAAGGVIVQAVQDILPPLH

SEQ ID NO: 751 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgttattgttcaggccgttcaggacattctgccgccgctgcat

SEQ ID NO: 752 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 753 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctgcaaggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaacattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgatgatgaacagggtctggatgaacatattgcacgtattagtgcagatattgcagcaggtggtcaaattgttcaggccgttcaggacattctgccgccgctgcat

SEQ ID NO: 754 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLQGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDDEQGLDEHIARISADIAAGGQIVQAVQDILPPLH

SEQ ID NO: 755 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctgcaaggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaacattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgatgatgaacagggtctggatgaacatattgcacgtattagtgcagatattgcagcaggtggtcaaattgttcaggccgttcaggacattctgccgccgctgcat

SEQ ID NO: 756 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLQGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDDEQGLDEHIARISADIAAGGQIVQAVQDILPPLH

SEQ ID NO: 757 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccgataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaacattaacagccagggttataccagcgcgaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgttattgttcaggccgttcaggacattctgccgccgctgcat

SEQ ID NO: 758 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTDNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 759 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaacattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgatgatgaacagggtctggatgaacatattgcacgtattagtgcagatattgcacagggtggtcaaattgttcaggccgttcaggacattctgccgccgctgcat

SEQ ID NO: 760 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDDEQGLDEHIARISADIAQGGQIVQAVQDILPPLH

SEQ ID NO: 761 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagcaggtggtgtgattgttcaggccgttcaggacattctgccgccgctgcat

SEQ ID NO: 762 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 763 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatattcaggcactgaatggtacaaatcagagctttcatccgtttatccataacagcaaaccgcatccgggtcagctgtgggcagcagatcagatgctaagcctgctgcaaggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaactgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtatgaaaggtctgcagatttgcggtaatagcattatgccgctgctgaccttttatggtaatagtattgcagatcgttttccgacccatgccgaacagttcaaccagaacattaacagccagggttataccagcgcgaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagcaggtggtcaaattgttcaggccgttcaggacattctgccgccgctgcat

SEQ ID NO: 764 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDIQALNGTNQSFHPFIHNSKPHPGQLWAADQMLSLLQGSQLVRDELDGKHDYRDGELIQDRYSLRCLPQYLGPIVDGIEQIAGQIETEINSVTDNPLIDVDNQASYHGGNFHGQYVGMGMDHLRYYIGLLAKHLDVTIALLASPEFSMGLPPSLVGNPERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 765 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgatgatgaacagggtctggatgaacatattgcacgtattagtgcagatattgcagccggtggtgttattgttcaggccgttcaggacattctgccgccgctgcat

SEQ ID NO: 766 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDDEQGLDEHIARISADIAAGGVIVQAVQDILPPLH

SEQ ID NO: 767 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaactgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtatgaaaggtctgcagatttgcggtaatagcattatgccgctgctgaccttttatggtaatagtattgcagatcgttttccgacccatgccgaacagttcaaccagaatattaacagccagggttataccagcgcgaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataatgaacagggtctggatgaacatattgcacgtattagtgcagatattgcagcaggtggtgtgattgttcaggccgttcaggacattctgccgccgctgcat

SEQ ID NO: 768 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIETEINSVTDNPLIDVDNQASYHGGNFHGQYVGMGMDHLRYYIGLLAKHLDVTIALLASPEFSMGLPPSLVGNPERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 769 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaactgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcgaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgttattgttcaggccgttcaggacattctgccgccgctgcat

SEQ ID NO: 770 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIETEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 771 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctgcaaggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagccggtggtgtgattgttcaggccgttcaggacattctgccgccgctgcat

SEQ ID NO: 772 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLQGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 773 - DNA, 1701 bp, Artificial Sequence
  Variant of Phenylalanine Ammonia Lyase from Anabaena variabilis
atgaaaaccctgagtcaggctcagagcaaaaccagcagccagcagtctagctttaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctgcaaggtagccagctggttcgtgatgaactggatggtaaacatgattatagggatggggaactgatccaggatcgttatgcgctgcgttgtctgccgcagtatctgggtccgattgttgatggtattgaacagattgccggtcaaatcgaaactgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtatgaaaggtctgcagatttgcggtaatagcattatgccgctgctgaccttttatggtaatagtattgcagatcgttttccgacccatgccgaacagttcaaccagaacattaacagccagggttataccagcgcgaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataatgaacagggtctggatgaacatattgcacgtattagtgcagatattgcacagggtggtgtgattgttcaggccgttcaggacattctgccgccgctgcat

SEQ ID NO: 774 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLQGSQLVRDELDGKHDYRDGELIQDRYALRCLPQYLGPIVDGIEQIAGQIETEINSVTDNPLIDVDNQASYHGGNFMGQYVGMGMDHLRYYIGLLAKHLDVTIALLASPEFSMGLPPSLVGNPERKVNMGMKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAQGGVIVQAVQDILPPLH

SEQ ID NO: 775 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtatatccataacagcaaaccgcatccgggtcagctgtgggcagcagatcagatgctaagcctgctggctggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagcaggtggtcaaattgttcaggccgttcaggacattctgccgccgctgcat

SEQ ID NO: 776 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPYIHNSKPHPGQLWAADQMLSLLAGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

SEQ ID NO: 777 - DNA, 1701 bp, Artificial Sequence
  Variant of Phenylalanine Ammonia Lyase from Anabaena variabilis
atgaaaaccctgagtcaggctcagagcaaaaccagcagccagcagtctagcttcaccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcagatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctggccggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaactgagattaacagcgttaccgataacccgctgattgatgttgataatcaggcaagctatcatggtggtaattttatgggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaacattaacagccagggttataccagcgcgaccctggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagcaggtggtgtgattgttcaggccgttcaggacattctgccgccgctgcat

SEQ ID NO: 778 - protein, 567 aa, Artificial Sequence
  Variant of Phenylalanine Ammonia Lyase from Anabaena variabilis
MKTLSQAQSKTSSQQSSFTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLAGSQLVRDELDGKHDYRDGELIQDRYSLRCLPQYLGPIVDGIEQIAGQIETEINSVTDNPLIDVDNQASYHGGNFMGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSATLARRSVEIFQNYVAIALMFGVQAVDLRTYKKTGHYDARAQLSPATERLYSAVRHVVGKKPSSDRPYIWNDNEQGLDEHIARISADIAAGGVIVQAVQDILPPLH

SEQ ID NO: 779 - DNA, 1701 bp, Artificial Sequence
  Variant of Phenylalanine Ammonia Lyase from Anabaena variabilis
atgaaaaccctgagtcaggctcagagcaaaaccagcagccagcagtctagccataccggcaatagcagcgcaaatgtgattattggtaatgataagctgaccatcaatgatgttgtacgtgttgcccgtaatggcaccgcggttagcctgaccaataatcctgatattctgcagcgtattcaggccagctgtgattatatcaataatgcagttgaaaaaggtgaaccgatttatggtgttaccagcggttttggtggtatggcaaatgttgtaattagccgtgaacaggcaagcgaactgcagaccaatctggtttggcacctgaaaaccggtgcaggtaataaactgccgctggcggatgttcgtgcagcaatgctgctgcgtgcaaatagccacatgcgtggtgcaagcggtattcgtctggaactgattaaacgcatggaaatctttctgaatgccggtgttaccccgtacgtttatgaatttggtagcattggtgccagcggtgatctggttccgctgagctatattaccggtagtctgattggcctggacccgagctttaaagttgattttaatggcaaagaaatggacgcaccgaccgcactgagacagctgaatctgccgccgctgaccctgcagccgaaagaaggtctggcaatgatgaatggcaccagcgttatgaccggtattgcagcaaattgtgttcacgatacccagattctgaccgcaattgcaatgggtgttcatgcactggatctgcaggcactgaatggtacaaatcagagctttcatccgtttatccataacagcaaaccgcatccgggtcagctgtgggcagcagatcagatgctaagcctgctgcaaggtagccagctggttcgtgatgaactggatggtaaacatgattatagggatggggaactgatccaggatcgttattcgctgcgttgtctgccgcagtatctgggtccgattgttgatggtattgaacagattgccggtcaaatcgaaattgagattaacagcgttaccgataacccgctgattgatgttgataatcaggcaagctatcatggtggtaattttcatggtcagtatgttggtatgggtatggatcatctgcgctattatatcggtctgctggcaaaacatctggatgttaccattgcactgctggcatcaccggaatttagcatgggtctgcctccgagtctggtgggtaatccggaacgtaaggttaatatgggtctgaaaggtctgcagatttgcggtaatagcattatgccgctgctgaccttttatggtaatagtattgcagatcgttttccgacccatgccgaacagttcaaccagaatattaacagccagggttataccagcgcggaactggcacgtcgtagcgttgaaatttttcagaattatgttgccattgccctgatgtttggtgttcaggcagttgatctgcgtacctacaaaaaaaccggtcattatgatgcacgtgcccagctgtcaccggcaaccgaacgtctgtatagtgcagttcgtcatgttgttggtaaaaaaccgagctcagatcgtccgtatatctggaatgataacgaacagggtctggatgaacatattgcacgtattagtgcagatattgcagcaggtggtcaaattgttcaggccgttcaggacattctgccgccgctgcat

SEQ ID NO: 780 - protein, 567 aa, Artificial Sequence
  Variant of Phenylalanine Ammonia Lyase from Anabaena variabilis
MKTLSQAQSKTSSQQSSHTGNSSANVIIGNDKLTINDVVRVARNGTAVSLTNNPDILQRIQASCDYINNAVEKGEPIYGVTSGFGGMANVVISREQASELQTNLVWHLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLPPLTLQPKEGLAMMNGTSVMTGIAANCVHDTQILTAIAMGVHALDLQALNGTNQSFHPFIHNSKPHPGQLWAADQMLSLLQGSQLVRDELDGKHDYRDGELIQDRYSLRCLPQYLGPIVDGIEQIAGQIEIEINSVTDNPLIDVDNQASYHGGNFHGQYVGMGMDHLRYYIGLLAKHLDVTIALLASPEFSMGLPPSLVGNPERKVNMGLKGLQICGNSIMPLLTFYGNSIADRFPTHAEQFNQNINSQGYTSAELARRSVEIFQNYVAIALMFGVQAVDLRTYKKTGHYDARAQLSPATERLYSAVRHVVGKKPSSDRPYIWNDNEQGLDEHIARISADIAAGGQIVQAVQDILPPLH

What is claimed is:

1. A recombinant tyrosine ammonia lyase having an amino acid sequence comprising at least 90%, at least 91%, at least 92%, at least 93%, at least 94%, at least 95%, at least 96%, at least 97%, at least 98%, or at least 99% sequence identity to SEQ ID NO: 2, wherein said recombinant tyrosine ammonia lyase comprise a mutation at position 237, and wherein said positions are numbered according to SEQ ID NO: 2.

2. The recombinant tyrosine ammonia lyase of claim 1, wherein said recombinant tyrosine ammonia lyase is thermostable.

3. The recombinant tyrosine ammonia lyase of claim 1, wherein said recombinant tyrosine ammonia lyase is resistant to proteolysis.

4. The recombinant tyrosine ammonia lyase of claim 3, wherein said recombinant tyrosine ammonia lyase is resistant to at least one digestive tract protease.

5. The recombinant tyrosine ammonia lyase of claim 4, wherein said digestive tract protease is selected from chymotrypsin, trypsin, carboxypeptidases, and elastases.

6. The recombinant tyrosine ammonia lyase of claim 1, wherein said recombinant tyrosine ammonia lyase is acid stable.

7. The recombinant tyrosine ammonia lyase of claim 1, wherein said recombinant tyrosine ammonia lyase is a deimmunized tyrosine ammonia lyase.

8. The recombinant tyrosine ammonia lyase of claim 1, wherein said recombinant tyrosine ammonia lyase is purified.

9. The recombinant tyrosine ammonia lyase of claim 1, wherein said recombinant tyrosine ammonia lyase exhibits at least one improved property selected from: i) enhanced catalytic activity; ii) reduced sensitivity to proteolysis; iii) increased tolerance to acidic pH; iv) reduced aggregation; v) decreased Km for tyrosine; vi) decreased immunogenicity; and a combination.

10. A composition comprising at least one recombinant tyrosine ammonia lyase of claim 1.

11. A pharmaceutical composition for the treatment of tyrosinemia, comprising the composition of claim 10 and a pharmaceutically acceptable carrier.

12. The pharmaceutical composition of claim 11, further comprising a pharmaceutically acceptable excipient.

13. The pharmaceutical composition of claim 11, wherein said composition is suitable for oral administration to a human.

14. The pharmaceutical composition of claim 11, wherein said composition comprises nitisinone.

15. The pharmaceutical composition of claim 11, wherein said composition comprises at least one phenylalanine ammonia lyase.

16. The pharmaceutical composition of claim 11, wherein said composition comprises nitisinone and at least one phenylalanine ammonia lyase.

17. The pharmaceutical composition of claim 11, wherein said composition is in the form of a pill, tablet, capsule, gelcap, liquid, or emulsion.

18. The pharmaceutical composition of claim 17, wherein said pill, tablet, capsule, or gelcap further comprises an enteric coating.

19. The pharmaceutical composition of claim 11, wherein said composition is suitable for parenteral injection into a human.

20. The pharmaceutical composition of claim 19, wherein said composition is coadministered with nitisinone.

21. The pharmaceutical composition of claim 19, wherein said composition further comprises nitisinone.

22. The pharmaceutical composition of claim 19, wherein said composition further comprises at least one phenylalanine ammonia lyase.

23. The pharmaceutical composition of claim 19, wherein said composition further comprises nitisinone and at least one phenylalanine ammonia lyase.

* * * * *